United States Patent 11,446,398 (REGULATED BIOCIRCUIT SYSTEMS) - sequence listing, part 68

SEQ ID NO: 166727 - DNA, 4430 bp, Homo sapiens
  Payload ID: 12823
  Gene Symbol: PLAGL1
  Gene Name: pleiomorphic adenoma gene-like 1
  Uniprot ID: Q9UM63
  ENST ID: ENST00000360537
  CDS Start-End: 1915-3306
gattgctgtcacgtctaatgtggctgctgcctcgtgtcacatctgaaactcatctgtacctcacttagaaagtggttctgattagacaagacttttcgttgcagtcgacagaaacctaatgggaccattgaagaattccaaacaggcaagtgacaggaacatatttgcatgttagaagaatcagcctggcagcagcattgtgattagaatgaaggggaaccgtccaaaaacagactggggaaccaatatggatctgcctctagcatgcggaaatatctctctacactgacctaactgactcactaagcttgtggtttgtttaaaggaagccacatgaaaattgagtttgggccaatagagtgaactcgttctccattctctagcatccctccccatgcaaccaccctatccctgccaagtttctgggcaccacagattggaaagtagcctcctgtaggtatttgcccatgttaagtggtggggtctctttctgtcttcccttcttggtctcacctgtctggtgtgacaagggaagcatgtgccaaccaaggctagacccttgtgagaccagagcagccccactttcggtaaagcaagcaacctctgcttacttgcccaacacaccctagcttccgtgttccttgccttgtgagttatcttcttgggtacaatttaacacagcgttcccacctccttataactaaaatagctagagggggctttgtgcctcaaaccccaaggagaccatcttggcaatctctgcctctgcaacagggcacttgctccctgggcaactcctttcccaggtcatcttctcccttgacatgcccatcagatttaatagtgtgcctatttggcagaaaaatggggtcccttggttgctgattcttaggaatgtgaggttctcccagccagagctctcagcactaaaagttctagtctctgcgtaatggccggcatatctttggcgtatctaaaatcctcttcagtttccagcagggtctttataagcttcttctgaaggtctcagacattcagccacggaactcaagtggaatttgtttggataacgtgactgatttcaaagcccggaccccttagacgtgcccatttggtgctgcaagtactgaccattactacaacatcttacagtcaacaaatttgacacattaaagatttatatcctttcttttgggttaggatcttctctcccctaaagcatctcagtttccagcatgcaatcatttccatcttatggaaatcagccatcccgctccgtgccagcatgctaccctgggaggcacatccaggcttgggaaacgggggtgtcctggatctcatgactccagcagcaccagctgctctctttcctcttccaagtagacttccgttccccccccacttgggtgtttttgtttgttttagcaattcagagctcaagataaagaccttaaagataactttgtgtgtctctccctttctaggtatttgcataggaatcagaggagttaatcttgtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaa

SEQ ID NO: 166728 - DNA, 2800 bp, Homo sapiens
  Payload ID: 12823
  Gene Symbol: PLAGL1
  Gene Name: pleiomorphic adenoma gene-like 1
  Uniprot ID: Q9UM63
  ENST ID: ENST00000367571
  CDS Start-End: 1269-2660
tgaataaatcacttaggcgagatataaattggctttgttccatagcagatttgcctttgtactagttaagaaaatcctgaaaagctttccctgtaagaggatcagttggttggaatagccttggtaggaagaagccaagtttgataattacttggtgaacggaaatgctggtttccaaatgctcatcagggttcagtggcacaaagctggctgtagacttggcttctgtagatttggtaaaaacgtaaattcctggggtcccagtgatgctgttttagtctgtactgatttgccctgtggccacccaggaatctgtatttttaaaagttttccatgctgattctaatgcatagccaggtttagtaaccatttaattcagtattcaacttagagacttcaaccttcttgcactgcaaatttgataaatctttgtttatatgaatctcctttgttgagtgccaactggttatttgctgactttctttcaattcagaatttgttttaggttctgttattgcatagatttgcatacctgttttatggtattttaatactgttggttttaaaaaataccatttcctctgagtgctgttctgaatatattatgtaagcaattttgtgtgttcttttttttccacttgcataaagcaggggaaaagttgagagtttttcttaatccagttgcaagtaggacaaaggatatgagtgtttaaagatcatctattaaaatgcatgaaaaaacactagaaaatctcctgtgcacatcgccagtcgtgtgtgtgctctagaagtgaagttcagggggtaacataatggaggaatgttttcctagcttcattccctgacgatgtacaaggtctcttctcacaggtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataaga

SEQ ID NO: 166729 - DNA, 2496 bp, Homo sapiens
  Payload ID: 12823
  Gene Symbol: PLAGL1
  Gene Name: pleiomorphic adenoma gene-like 1
  Uniprot ID: Q9UM63
  ENST ID: ENST00000367572
  CDS Start-End: 175-1410
gctcaagataaagaccttaaagataactttgtgtgtctctccctttctaggtatttgcataggaatcagaggagttaatcttgtctcttctcacaggtttgaatcttcagacaaacttctgggaggactcggtccctgcctcgcagcagatgttccctgtcactcagtaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaac

SEQ ID NO: 166730 - DNA, 6296 bp, Homo sapiens
  Payload ID: 12823
  Gene Symbol: PLAGL1
  Gene Name: pleiomorphic adenoma gene-like 1
  ENST ID: ENST00000392307
  CDS Start-End: 4416-5174
tattcttattctctcctcgcattacagcacaaaccagagccttcgcctcctccatggtagaggggcttatgtcccagaaaagactttgtgagagaatttacatttgaggaacttcaggccttgagggggaaaataaggttgggggattaagatgtggacttaatgaaagcctgtttttcactctaaaaattcaagaggacacgctaagaacgatcattgctatttatctgtcttaaattagaaatcatgggcattgtacagttgatttttacttatcatgacttgctcactagaaacttcgtgatctctttctgttatattttaaaaagatgtttttaaatggttttatcttaaagaaatattaggaaaaaaaaaactgaggtagggtccaccatttagaatcagatatctagaatgtaacgtatgttacaattcagagtctctaaaccactctcctaaaatcataatatgagatgattctcagcttgccaaattttctagagttgtgaaataggttatgtcactcaaccagtgtttatttgagggaattcatggttggcagggtccccattatacatcagaagtttttatttcttattttctatcactcatgtaaagattaggatttgtttgaactgcctatttcaagataatgattccaaatcccagccttaaatttcatatctaacatgtttgttgtttttccctgtcccatacattaattctaggttcaaggccatgtcaccctaaagcagccctcacttcttttgcagctgcagtgctgttgcttaaccataactcttggcctctctccagactgtttttttttttttttttttttgcaaaatgtccttgatggtcataatggtgtattttttaaaaattccagttgtttttgtaagttttcttatatcccatcttacattcaattccccctgcaaacctcccactagataaaccacttcccgctctattctttgtcttgagactgacttctaggaaggctgtccacagctgcctcaggccgaaggctaactaggagaatattaggtcgtgtgcttggattcctgttctccaaacgattctaattaaaactagtccactacccccaccaacacgttcagaaggaaaaaaatgtagcagaatccccaaatgccctcatcacttcattataccatttgggtagctttatggcacctgtaggactagttcatgccaggcccatttgtaactgttttctctagttaaacatgatattgccattaacagcacattaaataggattacactgcttaagaatctaggaatttctcaaatatatgagaaaatgtgaaagcacagggataatagaaatttattttataaacacatgctaggagatggaattgtgtcatgatgatccacattaaagaaacatgattgaagtgaatccattatttatactctgactttccattatatatatatattactccaaaagaagttattcatgtttcctaattgtgagcttacccatcgtgtaaaattggccctaacacttattcacaggccacatctacttcgtacatgtactttgcctctgtatgtacacgtgtaacgcataaccgtatatcagctctgcaagatacatagatatccccattttatggtgacggagactgaggcttagagaagttatgcaacttacctaaagttacacaccttccaagcagcagagccagcattcgaacttagacccatctgactccaaagccagtgccctctacactagaccacactgtctttcttaggttggatctaaaaaaatactaccagctggttggttttttaactaactgtaggaacacaacctagtattaagtagagtatgcatgctgcatagtggactgaggtagagtaaaacccattattgtaccacttttaggtaagaaaatgtattatctaaggaatatcattaaaatttccttacttccctccatgaacaaacaaaaaattaaaatgaaagcagtgggggatgaagggaggcggggatcataacataggagtgttaaatattaaaattagaaaagaaaataatttctctatcaatgtttaaaatgctagaaattatgcatgcttatactataacaaagaatactttatttggggaataacttaattgatccatgatgtggcatttaccaaggtaatttttccctttttgttccagcagtaggaattagaggtggttcataaaacacacaatcaccatgtaaattgaaaccgcattaagatcatagtcatcttatgttgtttccctaaaatggttctcatttgccccacatattcaaatcagagtgcacaaagatgttgtgctgagtcagggaagatttagaatgctctgtgaacagttttatactgaacttcagagttcagttattgtacttattttttggtgtgtgtgtgtgcacagttgggttttttgtttgttttgctatttgaattactgtttggccattttaatgtatataactgataaatccaggaggataatctgtatgtctgctctctcagtttctttctataacacaagcctgaacatattgctctcctgattaacaactttcagtggttctgattagacaagacttttcgttgcagtcgacagaaacctaatgggaccattgaagaattccaaacaggcaagtgacaggaacatatttgcatgttagaagaatcagcctggcagcagcattgtgattagaatgaaggggaaccgtccaaaaacagactggggaaccaatatggatctgcctctagcatgcggaaatatctctctacactgacctaactgactcactaagcttgtggtttgtttaaaggaagccacatgaaaattgagtttgggccaatagagtgaactcgttctccattctctagcatccctccccatgcaaccaccctatccctgccaagtttctgggcaccacagattggaaagtagcctcctgtaggtatttgcccatgttaagtggtggggtctctttctgtcttcccttcttggtctcacctgtctggtgtgacaagggaagcatgtgccaaccaaggctagacccttgtgagaccagagcagccccactttcggtaaagcaagcaacctctgcttacttgcccaacacaccctagcttccgtgttccttgccttgtgagttatcttcttgggtacaatttaacacagcgttcccacctccttataactaaaatagctagagggggctttgtgcctcaaaccccaaggagaccatcttggcaatctctgcctctgcaacagggcacttgctccctgggcaactcctttcccaggtcatcttctcccttgacatgcccatcagatttaatagtgtgcctatttggcagaaaaatggggtcccttggttgctgattcttaggaatgtgaggttctcccagccagagctctcagcactaaaagttctagtctctgcgtaatggccggcatatctttggcgtatctaaaatcctcttcagtttccagcagggtctttataagcttcttctgaaggtctcagacattcagccacggaactcaagtggaatttgtttggataacgtgactgatttcaaagcccggaccccttagacgtgcccatttggtgctgcaagtactgaccattactacaacatcttacagtcaacaaatttgacacattaaagatttatatcctttcttttgggttaggatcttctctcccctaaagcatctcagtttccagcatgcaatcatttccatcttatggaaatcagccatcccgctccgtgccagcatgctaccctgggaggcacatccaggcttgggaaacgggggtgtcctggatctcatgactccagcagcaccagctgctctctttcctcttccaagtagacttccgttccccccccacttgggtgtttttgtttgttttagcaattcagagctcaagataaagaccttaaagataactttgtgtgtctctccctttctaggtatttgcataggaatcagaggagttaatcttgcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgc

SEQ ID NO: 166731 - DNA, 2640 bp, Homo sapiens
  Payload ID: 12823
  Gene Symbol: PLAGL1
  Gene Name: pleiomorphic adenoma gene-like 1
  Uniprot ID: Q9UM63
  ENST ID: ENST00000437412
  CDS Start-End: 283-1518
ccttttccgcgccgccgagtcggagctgcgccgcacgcccagcggccgcccggacccgccggccggagctgacccagtgggccacgggctccggactccagaactttccaagcgggggaaacttggcggcgggattgctgtcacgtctaatgtggctgctgcctcgtgtcacatctgaaactcatctgtacctcacttagaaaggtttgaatcttcagacaaacttctgggaggactcggtccctgcctcgcagcagatgttccctgtcactcagtaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgc

SEQ ID NO: 166732 - DNA, 1645 bp, Homo sapiens
  Payload ID: 12823
  Gene Symbol: PLAGL1
  Gene Name: pleiomorphic adenoma gene-like 1
  Uniprot ID: Q9UM63
  ENST ID: ENST00000417959
  CDS Start-End: 410-1645
gcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcagggattgctgtcacgtctaatgtggctgctgcctcgtgtcacatctgaaactcatctgtacctcacttagaaagacttttcgttgcagtcgacagaaacctaatgggaccattgaagaattccaaacaggtatttgcataggaatcagaggagttaatcttgtttgaatcttcagacaaacttctgggaggactcggtccctgcctcgcagcagatgttccctgtcactcagtaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataa

SEQ ID NO: 166733 - DNA, 3237 bp, Homo sapiens
  Payload ID: 12823
  Gene Symbol: PLAGL1
  Gene Name: pleiomorphic adenoma gene-like 1
  Uniprot ID: Q9UM63
  ENST ID: ENST00000416623
  CDS Start-End: 724-2115
gttccggctcccgagccccgcctgcgcgcggcctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcagggattgctgtcacgtctaatgtggctgctgcctcgtgtcacatctgaaactcatctgtacctcacttagaaagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgc

SEQ ID NO: 166734 - DNA, 3197 bp, Homo sapiens
  Payload ID: 12823
  Gene Symbol: PLAGL1
  Gene Name: pleiomorphic adenoma gene-like 1
  Uniprot ID: Q9UM63
  ENST ID: ENST00000444202
  CDS Start-End: 684-2075
ccttttccgcgccgccgagtcggagctgcgccgcacgcccagcggccgcccggacccgccggccggagctgacccagtgggccacgggctccggactccagaactttccaagcgggggaaacttggcggcggattgttcctgcctgattcataaacatcgtgattggcttttgattgctgtcacgtctaatgtggctgctgcctcgtgtcacatctgaaactcatctgtacctcacttagaaagtcgacagaaacctaatgggaccattgaagaattccaaacaggtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgc

SEQ ID NO: 166735 - DNA, 588 bp, Homo sapiens
  Payload ID: 12823
  Gene Symbol: PLAGL1
  Gene Name: pleiomorphic adenoma gene-like 1
  ENST ID: ENST00000627449
  CDS Start-End: 369-588
ccttttccgcgccgccgagtcggagctgcgccgcacgcccagcggccgcccggacccgccggccggagctgacccagtgggccacgggctccggactccagaactttccaagcgggggaaacttggcggcggattgttcctgcctgattcataaacatcgtgattggcttttgattgctgtcacgtctaatgtggctgctgcctcgtgtcacatctgaaactcatctgtacctcacttagaaaggtatttgcataggaatcagaggagttaatcttgtctcttctcacaggtttgaatcttcagacaaacttctgggaggactcggtccctgcctcgcagcagatgttccctgtcactcagtaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtg

SEQ ID NO: 166736 - DNA, 3216 bp, Homo sapiens
  Payload ID: 12823
  Gene Symbol: PLAGL1
  Gene Name: pleiomorphic adenoma gene-like 1
  Uniprot ID: Q9UM63
  ENST ID: ENST00000625622
  CDS Start-End: 1147-2538
ctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcagggattgctgtcacgtctaatgtggctgctgcctcgtgtcacatctgaaactcatctgtacctcacttagaaagtcgacagaaacctaatgggaccattgaagaattccaaacaggcaagtgacaggaacatatttgcatgttagaagaatcagcctggcagcagcattgtgattagaatgaaggggaaccgtccaaaaacagactggggaaccaatatggatctgcctctagcatgcggaaatatctctctacactgacctaactgactcactaagcttgtggtttgtttaaaggaagccacatgaaaattgagtttgggccaatagagtgaactcgttctccattctctagcatccctccccatgcaaccaccctatccctgccaagtttctgggcaccacagattggaaagtagcctcctgtatttgcataggaatcagaggagttaatcttgtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgac

SEQ ID NO: 166737 - DNA, 563 bp, Homo sapiens
  Payload ID: 12823
  Gene Symbol: PLAGL1
  Gene Name: pleiomorphic adenoma gene-like 1
  ENST ID: ENST00000628651
  CDS Start-End: 257-563
cttttccgcgccgccgagtcggagctgcgccgcacgcccagcggccgcccggacccgccggccggagctgacccagtgggccacgggctccggactccagaactttccaagcgggggaaacttggcggcgggtaggtaggaaaggcaggattgctgtcacgtctaatgtggctgctgcctcgtgtcacatctgaaactcatctgtacctcacttagaaaggtatttgcataggaatcagaggagttaatcttgcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaaga

SEQ ID NO: 166738 - DNA, 333 bp, Homo sapiens
  Payload ID: 12823
  Gene Symbol: PLAGL1
  Gene Name: pleiomorphic adenoma gene-like 1
  ENST ID: ENST00000626373
  CDS Start-End: 298-333
ctccggactccagaactttccaagcgggggaaacttggcggcgggtaggtaggaaaggcaggattgctgtcacgtctaatgtggctgctgcctcgtgtcacatctgaaactcatctgtacctcacttagaaagtttctttctataacacaagcctgaacatattgctctcctgattaacaactttcagtggttctgattagacaagacttttcgttgcagtcgacagaaacctaatgggaccattgaagaattccaaacaggtatttgcataggaatcagaggagttaatcttgcatatggctacccattctccccagaaatctcaccagtgt

SEQ ID NO: 166739 - DNA, 587 bp, Homo sapiens
  Payload ID: 12823
  Gene Symbol: PLAGL1
  Gene Name: pleiomorphic adenoma gene-like 1
  ENST ID: ENST00000626462
  CDS Start-End: 364-587
ccttttccgcgccgccgagtcggagctgcgccgcacgcccagcggccgcccggacccgccggccggagctgacccagtgggccacgggctccggactccagaactttccaagcgggggaaacttggcggcggattgttcctgcctgattcataaacatcgtgattggcttttgattgctgtcacgtctaatgtggctgctgcctcgtgtcacatctgaaactcatctgtacctcacttagaaagtcgacagaaacctaatgggaccattgaagaattccaaacaggtttgaatcttcagacaaacttctgggaggactcggtccctgcctcgcagcagatgttccctgtcactcagtaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccct

SEQ ID NO: 166740 - DNA, 723 bp, Homo sapiens
  Payload ID: 12823
  Gene Symbol: PLAGL1
  Gene Name: pleiomorphic adenoma gene-like 1
  ENST ID: ENST00000629195
  CDS Start-End: 532-723
ctgagctccgggggtcgtcgccccgcagggattgctgtcacgtctaatgtggctgctgcctcgtgtcacatctgaaactcatctgtacctcacttagaaaggtatttgcataggaatcagaggagttaatcttgtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgt

SEQ ID NO: 166741 - DNA, 593 bp, Homo sapiens
  Payload ID: 12823
  Gene Symbol: PLAGL1
  Gene Name: pleiomorphic adenoma gene-like 1
  ENST ID: ENST00000626294
  CDS Start-End: 354-593
cttttccgcgccgccgagtcggagctgcgccgcacgcccagcggccgcccggacccgccggccggagctgacccagtgggccacgggctccggactccagaactttccaagcgggggaaacttggcggcggattgttcctgcctgattcataaacatcgtgattggcttttgattgctgtcacgtctaatgtggctgctgcctcgtgtcacatctgaaactcatctgtacctcacttagaaaggtatttgcataggaatcagaggagttaatcttgtttgaatcttcagacaaacttctgggaggactcggtccctgcctcgcagcagatgttccctgtcactcagtaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcacc

SEQ ID NO: 166742 - DNA, 5705 bp, Homo sapiens
  Payload ID: 12824
  Gene Symbol: PLAGL2
  Gene Name: pleiomorphic adenoma gene-like 2
  Uniprot ID: Q9UPG8
  ENST ID: ENST00000246229
  CDS Start-End: 266-1756
cgcggcaccgccccctccacgacccgagcgcccgctcgcgcggctcccacaatgcaccgcacaatggcccgaccgccgccactaccggggcctgagggggcctggcggagcccgagcgcggcccggcccgcagcgtggggccccgagcgcggtgaagagattgttttctgaaagctgcgttggaggctgtgacagagctgagagcctgtgtggagcggatggggaggctttctcaataacatggccctttgccattagccttgccatgaccacatttttcaccagcgtccccccctggattcaagatgcaaagcaggaggaggaagtgggctggaaactagttcccaggcctcggggccgggaggcggagagtcaagtgaagtgccaatgtgaaatttcgggaacacctttctcaaatggggagaagctgaggcctcacagcctcccgcaaccagagcagagaccatatagctgccctcagctgcactgtggcaaggcttttgcttccaaatacaagctgtataggcacatggccacccactcagcccagaaaccccaccagtgtatgtactgtgataagatgtttcaccgcaaggaccatctgcggaaccatctgcagacccatgatcctaacaaagaggccctccactgctctgagtgcggtaagaattacaatacgaagctgggctaccggcgccacctggccatgcatgctgccagcagcggtgacctcagctgcaaggtgtgcctgcagacctttgagagtacccaggccctgctagagcacctgaaggcccactcacgccgggtagcaggcggtgccaaggagaagaagcacccctgtgaccactgcgaccggcggttctatactcgtaaggatgtacggcggcacctagtggtgcacacaggccgtaaggacttcctgtgccagtactgtgcccagcggtttggccgtaaggaccacctgacgcgtcatgtcaagaagagccactcgcaggagctgctcaagatcaagacagagcccgtggacatgttaggcctactcagctgcagctccacagtcagtgtgaaggaagagctgagccctgtgctgtgcatggcctctcgggacgtaatggggaccaaggccttccctggcatgttgcccatgggcatgtatggtgcccacatccctaccatgcccagcacgggcgtgccacactccctggtgcacaacacgctgcccatgggtatgagctaccctctggaatcctcacctatctcttccccagctcagctccctccaaaataccagcttggatctacctcatacttgcccgacaaattgcccaaagtggaggtggatagttttctggcggagcttcctggaagcctgtctctctcatccgctgaaccccagcccgcctcacctcagccggcggcagctgcggccctcctagatgaagcactgcttgccaagagccccgccaacctctctgaggccctctgcgctgctaatgtggacttctcccacctactgggctttcttccactcaacctgcccccgtgtaacccacctggggccacaggaggcctggtcatgggctactcccaggctgaggcacagcccctgcttaccactttgcaagctcagcctcaagattccccaggagctgggggaccactgaactttgggcctctgcactccttgcctcctgtcttcacgtctggcctgagtagcaccaccctgcctcgtttccatcaagcattccagtagcccccacagaggccctcagctcagtttttggctctgttatggagccttagtacccaccccgtctgtgtcccccatgaaggcagctgagctttcagagctgggttcaaaaaaaaaaattccagtgtctgtatacaggagcacttggtttgggggttcaggctctaggatcgattccagaaggagccttgagccccaaccccgtgaaaagatctcataccgtaggacttcaggtattatttacttttatttttttgacctgaatcgggagccacacttggccctcttcctctccaaagcgccagaacctccttctctttggagaatggggaggcctcttggagacacagagggtttcaccttggatgacctctagagaaattgcccaagaagcccaccttctggtcccaacctgcagaccccacagcagtcagttggtcaggccctgctgtagaaggtcacttggctccattgcctgcttccaaccaatgggcaggagagaaggcctttatttctcgcccacccattcctcctgtaccagcacctccgttttcagtcagtgttgtccagcaacggtaccgtttacacagtcacctcagacacaccatttcacctcccttgccaagctgttagccttagagtgattgcagtgaacactgtttacacaccgtgaatccattcccatcagtccattccagttggcaccagcctgaaccatttggtacctggtgttaactggagtcctgtttacaaggtggagtcggggcttgctgacttctcttcatttgaggtcacatttttcccccgtggggaaataaactgactttggactgcttcagtctctgccatcttccatgactgcatttgttcctgcctgcctcggcggtatccacagaagacaggcaagaggattggagcagttttctcacaggtctgcaattctgtttttctccaagtacattatgaccccctcatccttctcttgaactggagaggggaagaaatgaaaggcatgcccacgtccgtcacctccccatcccctagtccccaccttgaacatcatgagctgttgttattagtcttggaagcagagtctgggttggtgtggatagcaaaggaggaagtctgagcccctcattggtcttcctcccacctgtcccttttccgggaagttgtggaattgttggaagaagagtttgcagaaggttaggaatgggtagatagctaagtcctaatctatgggtacattgttgtgtcccaaaccaaaattttccttatccacaatgtcccttctgtctcttccactttacagtggactcggccactgtgcataggcttctctgctctccatcaaatcacttccactttcctgtgcccccacccccgcctccagttttccgctagtatccggcaaggtttcttgcaacaaatgattagttcttttcttctgactcgtggggctccctgctgcagagagcacagcccttgcctggagcccaggaaccccatccttgcttcatctcagttcttcatgggcttcactcttcccactcacggaagggaggtagctcagggacctccactgtgggacccttgagacgcttccactctgattcagaaacacacttctacctctttactgttaactcttaacagatgcagtcagcagtttctgggcacttctctcagtaggtgcctcatgctgacttctccagtagggtttcaggacaaactaccaaggaattgcctcagcctcctaccagtcctccctcacccaccttctgtctaggttcacttggtttgtcatcaggaactgagcaggtccaggactcagctttctgcttcagcctaagccagtactccttgtttgaggtaaaagccttaaaatttagctccctagctcttgattagaagcaatttggagtaagtgtgttttgatttaggcagggtagcttgggatacctttttaaaaacaccagatattaaaatgtctggcaaggttagaatcagactagatgatttgcttctaaaaattagtttcagtgagtcccagggactaattaaggtttattttaaaaagtgtctaccttggtacgcagccacctcctgcatgctgtgcatgttattgggacttgtattataggtgatggtatgtgagaatccagttgggactcgctgttgccatcctctttgttgtatctggttttcatcactagactcagcaacccttctcaccttaactgccaccttccctacactctcagtttacagaggccactgggcctctggctgcagaatacaaagtcccgggctgttagaggagtcctttcctctctgcctgccctttcctgtccctccctcgaattctctctccccgtaagtgatgctggaaaagtcataggactggcaaagcaactgtttaaaccctttgtaaccggggccttgcccccacctcctgtcttttctccttgccttccccactcctgtgtcctcccatctatcctgtctttcctttcctcctctcagtgtcctcagcacccacaaggaattttcctatcactgtgaactttgctggtacagaggaataatatctgccttcacctttttttttttggaccatagctagccagtcatttcttaaacctcccttcctaaaatctggggggtcggggggaaagaaaaaaaaagccttagtggcctggttgttcaaaggataagaatagctttatcctgcactcagtacccgaactcacttcagtatgcttactgaggccatgagaacctgaggggcatctgcccaggacaggagccatggcatatgacaaagaccaatgagggaccaggaaaaaaagtgatgtcccctttccctgccacctccagcctctgccagcaatgagctgtccccctcccaccctacacagtagctggtcagggctgagtacagtcctgggggtaaggggatgacatgcccaggtgtcagctcaaaggatctctgcatcatcttgaggtgggaggcagggaaaggagcgccaatgaggttccctgcaacccccgccctccagcccaccgcccaaccttttacaaatggcattttcttaattgaaaatccgggaagcaggtgtgattacttttttgctcgtagatattgtcctaagttggaattctcccactgccctaaaactttccctagtagtcctttaaactcccccctccctttttggtagctgttttctccgtcctctctccacctgccctcttatctaggagctgtttgtaagcacgatttttttaacaggttatattgtacaggatcaatattttgctttttaacaaggatatttatgtaataagaaactttgccttaggcaggtgttggccagaaaagtccagattcctctgggatcccaccctggcctctcctggaactctgaacctgctgtggaaggaattggccatgaccttcacctctggagagtagggtctatggcgagggaaaagggtgttcaccatgataacctagtgcctccatagaggggtttggaaaaattccagtccgatttctttgtgtgtcagctgacttccttagctgattgttcccacttgcacctctccacctttggcactagaactcctgagacaccacttctcatgcttctccctccctaccagcggtcaaggctttggagccactcttttgtaactccagattatttaaagagaaaagtacaagacagaaatcttctagcactttgtaaacacagtgaataacctcttggagtatttttggctttatataaaacaaggtttttaattgtaaagtataagtgccattagaaaatgcacagggcatatctttgttaaagtagatttttcaatgttttacagaattacattttcaaaaaaaggtttttataatgaagttgtttattaaaaacttctgaatgatgtgttt

SEQ ID NO: 166743 - DNA, 1614 bp, Homo sapiens
  Payload ID: 12825
  Gene Symbol: PTN
  Gene Name: pleiotrophin
  Uniprot ID: P21246
  ENST ID: ENST00000348225
  CDS Start-End: 429-935
ttgctccgcagggagagactgcccctggagtattctgcttttaataagcttcccaatcagctctcgagtgcaaagcgctctccctccctcgcccagccttcgtcctcctggcccgctcctctcatccctcccattctccatttcccttccgttccctccctgtcagggcgtaattgagtcaaaggcaggatcaggttccccgccttccagtccaaaaatcccgccaagagagccccagagcagaggaaaatccaaagtggagagaggggaagaaagagaccagtgagtcatccgtccagaaggcggggagagcagcagcggcccaagcaggagctgcagcgagccgggtacctggactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaa

SEQ ID NO: 166744 - DNA, 1599 bp, Homo sapiens
  Payload ID: 12825
  Gene Symbol: PTN
  Gene Name: pleiotrophin
  ENST ID: ENST00000393083
  CDS Start-End: 338-838
cccagccttcgtcctcctggcccgctcctctcatccctcccattctccatttcccttccgttccctccctgtcagggcgtaattgagtcaaaggcaggatcaggttccccgccttccagtccaaaaatcccgccaagagagccccagagcagaggaaaatccaaagtggagagaggggaagaaagagaccagtgagtcatccgtccagaaggcggggagagcagcagcggcccaagcaggagctgcagcgagccgggtacctggactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagagaagggaaaatggagacacaggagtggggagagtttgagaagatggtagagaggagtgtttgggtgaagggagatggattcgtctactgatgcaactgcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaa

SEQ ID NO: 166745 - DNA, 1673 bp, Homo sapiens
  Payload ID: 12826
  Gene Symbol: PLRG1
  Gene Name: pleiotropic regulator 1
  Uniprot ID: O43660
  ENST ID: ENST00000302078
  CDS Start-End: 90-1607
tccggaaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggggttgctttgacagcagatactaagatccagagaatgccaagtgaatcagctgcacagtccttagcggtggcattacctttgcagaccaaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttc

SEQ ID NO: 166746 - DNA, 723 bp, Homo sapiens
  Payload ID: 12826
  Gene Symbol: PLRG1
  Gene Name: pleiotropic regulator 1
  ENST ID: ENST00000504341
  CDS Start-End: 87-723
ctcagttgctaaacctgaggttctagccaaagaggagcttcctcctcttctctgaacttgactcctgtagcttgcaacaagtagctatggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtccttagcggtggcattacctttgcagaccaaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctg

SEQ ID NO: 166747 - DNA, 3351 bp, Homo sapiens
  Payload ID: 12826
  Gene Symbol: PLRG1
  Gene Name: pleiotropic regulator 1
  Uniprot ID: O43660
  ENST ID: ENST00000499023
  CDS Start-End: 128-1672
gcagagcttgcatcacatccgccgcctgggcgcccaattccggaaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtccttagcggtggcattacctttgcagaccaaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtcccctacccctgtgtttttatttctaaaacaatttgtgatactaggaagatgcagatatcaagtaaatgcaggtttattgaacataactattctagatgtaatattttgacagtcttattagaaaacccccttttttaaaaaaaatgtatgaaaccgataattaggacatttgaaggagcagtagtttttttttagtcctttaaaaaataacatctgtgactaataatttgagattaaaagatttgaagtcttaatttatgtatgtttattccaaaaacagtttttgagtgtatgttctacaaagttctgcactagatactgttcaggaaatagacaagtaagatgtgtctatcctctaagacttccagtttggtagcttagtatagaaattctgtaacagaggtgcaggtgaaatgctgggggaacagaagggataagaccatttatttttctcaggaaggattgtggaagacttcatagagtaagtggcattggagattaccttgaagtgaaggaagacaaagaaggaaaagagatgaggcataaagtgatgaaaccaggcacaagaaagtgtgcggtgtgttctgggacaaagaatgttctgctactgtcgaataatgggactaaagctggcttgttctggggaaagctcatataagtatggattttattcctcaactagtaggataccaatactggtattgaaacttggggaaaataactggagataccagtgcagctatttaaagctgtagcaagggctgcaatcttgcggagattttaaagagaagttttaaagtttctaatactgatgcctctttttggtaaatacaagttttataaatcctgccctgggatcctgattccccattaatcaagatttgtcagacttcaccttctataattagaaaacacagttataagaacagtcaattttttaaattttccaaattaaaaaattgcaccatgattttgaacaagcacttccaattacattacccatcttgtatgccataggtgggagtataattgtcacagcctttaggaatgtagttttctgggatttattgaaactttgaaccttttggcctactaagttcattcctaggaaactgcctaatgggaatgatctgacaagtgtacacaagcaaagtcattgcacctttgttctttaatacttaaaactagcccaaatgccctgtcagtaagggactggtttaatagatggtacctttatgcaatttgtttctaagtattcgttaagagagtgaggaatgtctggattattagggcaagatttctaaacttgggtaaaaaaaaaagttgtgcaagcatttttgtggacaacttgatgctctaaaatataagtaacaccacattactaacagtggctttgttaggaagcagaattatggaagaactttcatgggtggctttacatatttctataatgttttaattttctataagcatgtatttcgtaaacttaaataaagaaaaaagaacact

SEQ ID NO: 166748 - DNA, 855 bp, Homo sapiens
  Payload ID: 12826
  Gene Symbol: PLRG1
  Gene Name: pleiotropic regulator 1
  ENST ID: ENST00000506192
  CDS Start-End: 85-480
aaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctgggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatt

SEQ ID NO: 166749 - DNA, 572 bp, Homo sapiens
  Payload ID: 12826
  Gene Symbol: PLRG1
  Gene Name: pleiotropic regulator 1
  ENST ID: ENST00000509975
  CDS Start-End: 87-263
ggaaggtgctgcacagctgtggcggcgggtactgcgttagtgattagagtttcttccctgccggaggtgggatacacggtagcatcatggtcgagtccaccttaattgagaccaacatcatctttcacctggactggtgcattagctccccgttggttggtttccttgcttccattttgttctataagttgttctgtttaaaacgaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtcctt

SEQ ID NO: 166750 - DNA, 998 bp, Homo sapiens
  Payload ID: 12826
  Gene Symbol: PLRG1
  Gene Name: pleiotropic regulator 1
  ENST ID: ENST00000506627
  CDS Start-End: 1-470
agatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacaataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcc

SEQ ID NO: 166751 - DNA, 365 bp, Homo sapiens
  Payload ID: 12826
  Gene Symbol: PLRG1
  Gene Name: pleiotropic regulator 1
  ENST ID: ENST00000503251
  CDS Start-End: 1-321
gatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagacagaagaaactcatccagtcagctggaaaccagaaattatcaagagaaagagattttaatgaatgtggaattttttctctctctttttttttctttttaattaaaaaaaaaaaagcttggcgttcatgaggatatccagtcatt

SEQ ID NO: 166752 - DNA, 9066 bp, Homo sapiens
  Payload ID: 12827
  Gene Symbol: PLXNA1
  Gene Name: plexin A1
  Uniprot ID: Q9UIW2
  ENST ID: ENST00000393409
  CDS Start-End: 1-5691
atgccgctgccaccgcggagcctgcaggtgctcctgctgctgctgctgttgctgctgctgctgccgggcatgtgggctgaggcaggcttgcccagggcaggcgggggttcacagccccccttccgcaccttctcggccagcgactggggcctcacccacctagtggtgcatgagcagacaggcgaggtgtatgtgggcgcagtgaaccgcatctataagctgtcggggaacctgacactgctgcgggcccacgtcacgggccctgtggaggacaacgagaagtgctacccgccgcccagcgtgcagtcctgcccccacggcctgggcagtactgacaacgtcaacaagctgctgctgctggactatgccgctaaccgcctgctggcctgtggcagcgcctcccagggcatctgccagttcctgcgtctggacgatctcttcaaactgggtgagccacaccaccgtaaggagcactacctgtccagcgtgcaggaggcaggcagcatggcgggcgtgctcattgccgggccaccgggccagggccaggccaagctcttcgtgggcacacccatcgatggcaagtccgagtacttccccacactgtccagccgtcggctcatggccaacgaggaggatgccgacatgttcggcttcgtgtaccaggatgagtttgtgtcatcacagctcaagatcccttcggacacgctgtccaagttcccggcctttgacatctactatgtgtacagcttccgcagcgagcagtttgtctactacctcacgctgcagctagacacacagctgacctcgcctgatgccgccggcgagcacttcttcacgtccaagatcgtgcggctctgtgtggacgaccccaaattctactcgtacgttgagttccccattggctgcgagcaggcgggtgtggagtaccgcctggtgcaggatgcctacctgagccggcccggccgtgccctggcccaccagctgggcctggctgaggacgaggacgtgctgttcactgtgttcgcccagggccagaagaaccgcgtgaagccaccaaaggagtcagcactgtgcctgttcacgctcagggccatcaaggagaagattaaggagcgcatccagtcctgctaccgtggtgagggcaagctctccctgccgtggctgctcaacaaggagctgggctgcatcaactcgcccctgcagatcgatgacgacttctgcgggcaggacttcaaccagcccctggggggcacagtcaccattgaggggacgcccctgttcgtggacaaggatgatggcctgaccgccgtggctgcctatgactatcggggccgcactgtggtattcgccggcacgcgaagtggccgcatccgcaagatcctggtggacctctcaaaccccggtggccggcctgccctggcctacgagagcgtcgtggcccaggagggcagccccatcctgcgagacctcgtcctcagccccaaccaccagtacctctacgccatgaccgagaagcaggtgacgcgggtgcctgtggagagctgtgtgcagtacacgtcctgtgagctgtgtctggggtcacgggacccccactgtggctggtgtgtcctgcacagcatctgctcgcggcgggacgcctgtgagcgagcagacgagccccagcgctttgctgcggacctgctgcagtgtgtgcagctgactgtgcagccccgcaatgtgtctgtcaccatgtcccaggtcccacttgtgctgcaggcctggaacgtgcctgacctctcagctggcgtcaactgctccttcgaggacttcacggaatctgagagcgtcctggaggatggccggatccactgccgctcaccctccgcccgggaggtggcgcccatcacgcggggccagggagaccagcgggtggtgaaactctacctaaagtccaaggagacagggaagaagtttgcgtctgtggacttcgtcttctacaactgcagcgtccaccagtcctgcctgtcctgtgtcaacggctcctttccctgccactggtgcaaataccgccacgtgtgcacacacaacgtggctgactgcgccttcctggagggccgtgtcaacgtgtctgaggactgcccacagatcctgccctccacgcagatctacgtgccagtgggagtggtaaaacccatcaccctggccgcacggaacctgccacagccacagtcaggccagcgtggatatgagtgcctcttccacatcccgggcagcccggcccgtgtcaccgccctgcgcttcaacagctccagcctgcagtgccagaattcctcgtactcctacgaggggaacgatgtcagcgacctgccagtgaacctgtcagtcgtgtggaacggcaactttgtcattgacaacccacagaacatccaggcgcacctctacaagtgcccggccctgcgcgagagctgcggcctctgcctcaaggccgacccgcgcttcgagtgcggatggtgcgtggccgagcgccgctgctccctgcgacaccactgcgctgccgacacacctgcatcgtggatgcacgcgcgtcacggcagcagtcgctgcaccgaccccaagatcctcaagctgtcccccgagacgggcccgaggcagggcggcacgcggctcactatcacaggcgagaacctgggcctgcgattcgaagacgtgcgtctgggcgtgcgcgtgggcaaggtgctgtgcagccctgtggagagcgagtacatcagtgcggagcagatcgtctgtgagatcggggacgccagctccgtgcgtgcccatgacgccctggtggaggtgtgtgtgcgggactgctcaccacactaccgcgccctgtcacccaagcgcttcaccttcgtgacaccaaccttctaccgtgtgagcccctcccgtgggcctctgtcagggggcacctggattggcatcgagggaagccacctgaacgcaggcagtgatgtggctgtgtcggtcggtggccggccctgctccttctcctggaggaactcccgtgagatccggtgcctgacaccccccgggcagagccctggcagcgctcccatcatcatcaacatcaaccgcgcccagctcaccaaccctgaggtgaagtacaactacaccgaggaccccaccatcctgaggatcgaccccgagtggagcatcaacagcggtgggaccctcctgacggtcacaggcaccaacctggccactgtccgtgaaccccgaatccgggccaagtatggaggcattgagagggagaacggctgcctggtgtacaatgacaccaccatggtatgccgcgccccgtctgtggccaaccctgtgcgcagcccaccagagctgggggagcggccggatgagctgggcttcgtcatggacaacgtgcgctccctgcttgtgctcaactccacctccttcctctactaccctgaccccgtactggagccactcagccccactggcctgctggagctgaagcccagctccccactcatcctcaagggccggaacctcttgccacctgcacccggcaactcccgactcaactacacggtgctcatcggctccacaccctgtaccctcaccgtgtcggagacgcaactgctgtgcgaggcgcccaacctcactgggcagcacaaggtcacggtgcgggcaggtggcttcgagttctcgccagggacactgcaggtgtactcggacagcctgctgacgctgcctgccattgtgggcattggcggaggcgggggtctcctgctgctggtcatcgtggctgtgctcatcgcctacaagcgcaagtcacgagatgctgaccgcacactcaagcggctgcagctccagatggacaacctggagtcccgcgtggccctcgaatgcaaggaagcctttgcagagctgcagacagacatccacgagctgaccaatgacctggacggtgccggcatccccttccttgactaccggacatatgccatgcgggtgctctttcctgggatcgaggaccaccctgtgctcaaggagatggaggtgcaggccaatgtggagaagtcgctgacactgttcgggcagctgctgaccaagaagcacttcctgctgaccttcatccgcacgctggaggcacagcgcagcttctccatgcgcgaccgcgggaatgtggcctcgctcatcatgacggccctgcagggcgagatggaatacgccacaggcgtgctcaagcagctgctttccgacctcatcgagaagaacctggagagcaagaaccaccccaagctgctactgcgccggactgagtcggtggcagagaagatgctaactaactggttcaccttcctcttgtataagttcctcaaggagtgcgctggggagccgctgttcatgctgtactgcgccatcaagcagcagatggagaagggccccattgacgccatcacgggtgaggcacgctactccctgagtgaggacaagctcatccggcagcagattgactacaagacactgaccctgaactgtgtgaaccctgagaatgagaatgcacctgaggtgccggtgaaggggctggactgtgacacggtcacccaggccaaggagaagctgctggacgctgcctacaagggcgtgccctactcccagcggcccaaggccgcggacatggacctggagtggcgccagggccgcatggcgcgcatcatcctgcaggacgaggacgtcaccaccaagattgacaacgattggaagaggctgaacacactggctcactaccaggtgacagacgggtcctcggtggcactggtgcccaagcagacgtccgcctacaacatctccaactcctccaccttcaccaagtccctcagcagatacgagagcatgctgcgcacggccagcagccccgacagcctgcgctcgcgcacgcccatgatcacgcccgacctggagagcggcaccaagctgtggcacctggtgaagaaccacgaccacctggaccagcgtgagggtgaccgcggcagcaagatggtctcggagatctacttgacacggctactggccaccaagggcacactgcagaagtttgtggacgacctgtttgagaccatcttcagcacggcacaccggggctcagccctgccgctggccatcaagtacatgttcgacttcctggatgagcaggccgacaagcaccagatccacgatgctgacgtgcgccacacctggaagagcaactgcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgagatcctggcagccctggagaaggatgagcaggcgcggcggcagcggctgcggagcaagctggagcaggtggtggacacgatggccctgagcagctgagccccagctgtgatcatccagcatgatgcagcgtgaggacagctgagcagggaccgggacagccctcaccgcatgcgtgtggagtgtccggtggtgctcgggccgccgcagtgcagcgactgcccggccctccctcccctgcctcacccggtcgggtcccggctcttcctgtgtggaggtgatggtacctgccacaccacagctgcgcacacagctgcttgctcaggggccgggacagcactgggtgctcaggctggccaaggaccttcattgcctggcaagagctgcccagtggccttcatgggagaagggctgacctctgaggggctgaggggtgaggccagggccctccagggggaggggtagccagcttgggctgtccccttgagaccaggacaagaggctgggggtgtcagcattcccagctttccaagctgcccccaggcggcagagtctgagggtcccggggcccggttggcagctggagaaagaggcaaaaagcccgtagccgggcaagaggagctcaagtcggtctgggcccgttgccaccgactcccacctccagcacccatgcccgctgcaccgctgccatcctcagattcaccgcgtgctctgcgcggccgaggccggagcaccacatccacctcgccccagagaggctctgctccctcctatggaggggctgtgggccaggctgctcagactcctgggtggcttccagacggaccgggcagcccctctccgtcctcagggctgtgcctctgggagccactgggccaggggccccgggtcgcagagagcacgttcccgttatttattcccctccgcgtcctacacaggctgccctggcagctgtcttcaagggtaggctgagctccccaccctggagcccctgagggcggcccctgagcactcctctctctccactctctctgtccctgccccagcggcttccagtgtggcatctcagcagtgtcctggcccctccagagcagtgggacatctggggactgtttttgtgtttaggggaaaaaattctgctgcactctgcttgggccttgaggtctgtggcagggctcctctggcccgcagtggcctggatctatctgggccatgagtgacgggcagtgaccagagggactggaggccagcggtgtccacccttgccctcagcaagagagaatgcattcttaaaagaaagctgtacatgtatatatatgcatatatatatatgtggctctagcctcaggctccagccccagtggggtactgtacagttaactgaagaagaattttaaagacgatttgaacaagaaaatgaaggcagtgggaaagcaatgccaaatggttgtggagaaagtggccggagcctccctggagtggagcagccctgaagcctgtgccccccgacctgcgggccgctgttttggtttgacatgacaaggaaaggacttcctgctgaccctgagagcctctggggtgccgcggcaccacggggcatgcatgattgtgctagcgtttagtctgagttgatctttttaaaactgcaagtgttgaatactagaggttgttagacccttttttatgttttttaattaatcagtcacttgtaaaagcaaacaagcggtccatccccttttcaaggtcacttttttgatggtaccgaagatcccatggacattaagggacagctaactgtggccagactcagccccatgtccttggccaggcccaaggagaggactcggccccatggggtgtgccagtcttgcagtccgccccagctgagtagcgtgagccagatgacgccacagagacccgcctcttccctgaacgcgggtcggtgtggagtcagtgactgctgactcagggagctccttggccccgtgggcactgtgccagggctggggccttctgctgctgccacacccagctcaggcctgggccagcccctgcccccagcccactgagggggtgggcttactccctgggcagtcttgggggccagagctgaggccagtccatattacagtggctgggctgtttttttcagtagcccctagcattggctgggattcctgttcctgggtgcgcctccacctcccttctgatgtttcctggctatggtggggtgggaacctcagtttcccccaaagtcttccctggatgctggcttcaggttgaagtccctggttcttccagttcctcacgggttaggtaggggctcctgcatcaccttcagaatccagttccaacccccactctccttaggccttgtgctctgctctgccctgccaggctgcccttgtccatgtgagtagcatgggcgggtggtggggacggcagtggtgatgaagggggtgcaccacaggcctcatgaagcagttcccacatgggcgtgtggctggggcgtggccaccacagagcacatggctgtgtctaggcgcaagcactttagcagtatctgtttacatgcgcaaggatcaagccgactacctgtgctgtctactgggacagcagtctccgagctactccgtacctccctctgccaggtcgtggagttaggccccagtccctacttgtcactggttcccactgtgctcctaactgtgcagcacctgggagctctggcctggggctggaggccctggtaggagctgcagttggaggccgttctgtgcccagcagcggtgagcggctcccatgggccctgtgtctgcagggagccagggctgcggcacatgtgctgtgaaactggcacccacctggcgtgctgctgccgccacttgcttcctgcagcacctcctaccctgctccgtgtcctccctctccccgcgcctggctcaggagtgctggaaaagctcacgcctcggcctgggagcctggcctcttgatatacctcgagcttcccctgtgctccccagccccaggaccactggccccttggcctgaggggctgggggccccacgacctgcagcgtcgagtccgggagagagcccggagcggcgtgccatctcggctcggccttgctgagagcctccgccctggctttctccctgtctggattcagtggctcacgttggtgctacacagctagaatagatatatttagagagagagatatttttaagacaaagcccacaattagctgtcctttaacaccgcagaaccccctcccagaagaagagcgatccctcggacggtccgggcgggcaccctcagccgggctctttgcagaagcagcaccgctgactgtgggcccggccctcagatgtgtacatatacggctatttcctattttactgttcttcagatttagtacttgtaaataaacacacacattaaggagagattaaacatttttgctaaaagct

SEQ ID NO: 166753 - DNA, 11444 bp, Homo sapiens
  Payload ID: 12828
  Gene Symbol: PLXNA2
  Gene Name: plexin A2
  Uniprot ID: O75051
  ENST ID: ENST00000367033
  CDS Start-End: 759-6443
cgccgccgccgccgccaccgcgggagccagagctgccgggaggagcggcatccgcgccagactggagcgggagggcggcggagggcagttgctgggaatttttcagccgagagggcgagcgatccggagagagaccccgagagcttgggagcggtagggcgtgcgagcgccgcagccagcggagcaaacctcgaaatagatctggaaagccaggctcccggaggaaatgggactgtgaacgaaccggagagcaagaagggaaggaagcgccgggattgctgatgtcagaggagcccggaaagtcgcgctggaaaaatctgaagacagccggggctctgcttcttcctcaggagagacaccgccggccgcccccacacgccccctcggcgcctccgggtgccccctgagagccggcgacagcgcccagccgggctgctgcggggcgacggaggactgaggggcgcgcggagcggagaccgaggagcgacttcaggaatacagataagtgtctggtggcttgacgtggattttaatgaatttggactccatgtggatttggtcgtctccctgattccgagctgcgggcagggagaggggcctcgcgccgccctcagcagccggcggcggccgaggtagaccgagcggggacggaaggacagaccgacgtcgccgagctggaatcatgtgagggccaaccggggaaggtggagcagatgagcacacacaggagccgtctcctcaccgccgcccctctcagcatggaacagaggcggccctggccccgggccctggaggtggacagccgctctgtggtcctgctctcagtggtctgggtgctgctggcccccccagcagccggcatgcctcagttcagcaccttccactctgagaatcgtgactggaccttcaaccacttgaccgtccaccaagggacgggggccgtctatgtgggggccatcaaccgggtctataagctgacaggcaacctgaccatccaggtggctcataagacagggccagaagaggacaacaagtcttgttacccgcccctcatcgtgcagccctgcagcgaagtgctcaccctcaccaacaatgtcaacaagctgctcatcattgactactctgagaaccgcctgctggcctgtgggagcctctaccagggggtctgcaagctgctgcggctggatgacctcttcatcctggtggagccatcccacaagaaggagcactacctgtccagtgtcaacaagacgggcaccatgtacggggtgattgtgcgctctgagggtgaggatggcaagctcttcatcggcacggctgtggatgggaagcaggattacttcccgaccctgtccagccggaagctgccccgagaccctgagtcctcagccatgctcgactatgagctacacagcgattttgtctcctctctcatcaagatcccttcagacaccctggccctggtctcccactttgacatcttctacatctacggctttgctagtgggggctttgtctactttctcactgtccagcccgagacccctgagggtgtggccatcaactccgctggagacctcttctacacctcacgcatcgtgcggctctgcaaggatgaccccaagttccactcatacgtgtccctgcccttcggctgcacccgggccggggtggaataccgcctcctgcaggctgcttacctggccaagcctggggactcactggcccaggccttcaatatcaccagccaggacgatgtactctttgccatcttctccaaagggcagaagcagtatcaccacccgcccgatgactctgccctgtgtgccttccctatccgggccatcaacttgcagatcaaggagcgcctgcagtcctgctaccagggcgagggcaacctggagctcaactggctgctggggaaggacgtccagtgcaccaaggcgcctgtccccatcgatgataacttctgtggactggacatcaaccagcccctgggaggctcaactccagtggagggcctgaccctgtacaccaccagcagggaccgcatgacctctgtggcctcctacgtttacaacggctacagcgtggtttttgtggggactaagagtggcaagctgaaaaagattcgggccgacggtcccccccatggtggggtccagtacgagatggtctctgtgctcaaggacggaagccccatcctccgggacatggccttctccattgatcagcgctacctgtacgtcatgtctgagagacaggtcaccagggtccccgtggagtcatgtgagcagtatacgacttgtggggagtgcctgagctctggggaccctcactgtggctggtgtgccctgcacaacatgtgctcccgcagggacaaatgccaacaggcctgggaacctaatcgatttgctgccagcatcagccagtgtgtgagccttgcagtgcatcccagcagcatctcagtatctgagcacagccggttgcttagcctggtagtgagtgatgctcctgatctatctgcgggtatcgcctgtgcctttgggaacctgacagaggtggaggggcaggtgtccgggagccaggtcatctgcatctcacctgggcccaaggatgtccctgtcatcccgctggatcaagactggtttgggctggagctacagctgaggtccaaggagacagggaagatatttgtcagcaccgagttcaagttttacaactgcagtgcccaccaactgtgcctgtcctgtgtcaacagcgccttccgctgccattggtgcaagtaccgcaacctctgcactcatgaccccaccacctgctccttccaggagggccggatcaatatttcagaggactgtccccagctggtgcccacagaggagatcttgattccagtcggggaggtaaagccaatcacccttaaggcgcgaaatctgccccagccgcagtccggccagcgaggctatgagtgtgtcctcaacatacaaggagccatccaccgggtccccgctctgcgcttcaacagctccagcgttcagtgtcagaacagctcgtaccagtatgatggcatggacatcagcaatctggccgtggatttcgctgtggtgtggaacggcaatttcatcattgacaaccctcaggacctgaaagtccatctctacaagtgtgcagcccagcgggagagctgcggcctctgcctcaaggccgaccggaagtttgagtgtggctggtgcagcggcgagcgcaggtgcaccctccaccagcactgtaccagcccttccagcccctggctcgactggtccagccacaatgtcaagtgctccaaccctcaaatcaccgagattttgacggtgtctggaccgccggaaggagggacgcgagtgaccatccatggcgtgaacctgggtctggacttctccgagatcgcccaccatgtgcaggtggctggggtgccctgcacgcccctcccaggggaatacatcatcgctgagcagattgtctgtgagatgggccatgccctcgtgggaaccacctccgggccagtacgcctgtgtattggcgagtgtaagccagagttcatgacgaagtcccatcagcagtacaccttcgtgaacccttctgtgctgtcactcaacccaatccgaggtcccgagtcaggaggcactatggtgaccattaccggccattaccttggggctgggagcagcgtggcagtctacctgggcaaccagacctgcgagttctacgggaggtcaatgagtgagatcgtgtgtgtctcacccccatcatccaatggccttggcccggtccctgtttctgtgagtgtcgaccgagcccatgtggatagcaacctgcagtttgagtacatagatgaccctcgggtccagcgcatcgagccagagtggagcattgccagtggccacacacccctgaccatcacaggcttcaacctggatgtcattcaggagccaaggatccgagtcaaattcaatggcaaagaatctgtcaatgtgtgtaaagttgtgaacacaaccaccctcacctgcctggcaccctctctgaccacggactaccgccctggcctggacactgtggaacgcccagatgagtttggatttgtctttaacaatgtccaatccttgctaatttacaacgacaccaagtttatctactaccccaacccgacctttgaactgcttagccctactggagtcttggatcaaaagccaggatcgcccatcattctgaagggcaaaaacctctgccctcctgcctctggaggggccaaactcaactacactgtgctcatcggagagaccccttgtgctgtcaccgtatctgagacccagcttctctgcgagcctcccaacctcaccgggcagcacaaggtcatggttcacgtgggcgggatggtgttctcgcctggctcggtgagtgtcatctcagacagcttgctgaccctgccagccatcgtcagcatcgcggccggcggcagcctcctcctcatcatcgtcatcatcgtcctcattgcctacaagcgcaagtctcgagaaaatgacctcactctcaagcggctgcaaatgcagatggacaatctggagtcccgtgtggccttggagtgcaaggaagcttttgctgagctccagacggatatcaatgagttgaccagtgacctggaccgctcaggaatcccttacctggactatcgtacctacgctatgcgagtcctgttcccgggcatcgaggaccaccccgtcctgcgggagctggaggtacaaggaaacgggcagcagcacgtggagaaggccctgaagctctttgcccagctcatcaacaacaaggtgttcctgctgaccttcatccgcaccctggagctgcagcgcagtttctccatgcgcgaccggggcaacgtggcttcgctcatcatgaccggcctgcagggccgcctggaatatgccactgatgtcctcaagcagctgctctctgacctcatcgataagaacctggagaacaagaaccaccccaagctgctactccggaggacagagtctgtggctgaaaagatgctgaccaattggttcgccttcctcctgcacaagttcctaaaggagtgcgcaggggagccactcttcatgctatactgtgccatcaagcagcagatggagaagggccccattgatgccatcacgggcgaggcccgctactccctgagcgaggacaagctcatccggcagcagatcgagtacaagaccctgatcctgaactgcgtcaaccctgacaacgagaacagtccagagatcccagtgaaggtgttaaactgtgacaccatcacacaggtcaaggagaagattcttgatgccgtgtataagaatgtgccctattcccagcggccgagggcagtggacatggacttggagtggcgccaaggccggatcgcccgggtcgtgctgcaagatgaggacatcaccaccaagattgagggtgactggaagcggctcaacacactgatgcattatcaggtgtcagacaggtcggtggtggctctggtccccaaacagacctcctcctacaacatccctgcctctgccagcatctcccggacgtccatcagcagatacgactcctccttcaggtatacgggcagccccgacagcctgcggtcccgggccccgatgatcaccccagacctggaaagtggggtcaaggtgtggcatctggtgaagaaccatgaccacggtgaccagaaggagggtgaccggggcagcaagatggtgtccgagatctacctgacccggctactggccaccaagggcaccctgcagaagtttgtggacgacttgtttgagaccttgttcagcactgtgcaccggggcagcgctctccccctggccatcaagtacatgtttgatttcctagatgagcaggcagacaggcacagcatccatgacacagatgtgcggcacacctggaaaagcaactgcctccctctgcgcttctgggtgaacgtgattaagaacccccagttcgtgtttgacatccacaagggcagcatcacggacgcctgcctctctgtggtggcccagaccttcatggactcttgttcaacgtcagagcaccggctgggcaaggactccccctccaacaagctgctctatgccaaggacatccccagctacaagagctgggtggagagatactacgcagacatcgccaagctcccagccatcagtgaccaggacatgaatgcctacctcgccgagcagtcccgcctgcacgccgtggagttcaacatgctgagtgccctcaatgagatctactcctatgtcagcaagtatagtgaggagctcatcggggccctagagcaggatgagcaggcacggcggcagcggctggcttataaggtggagcagctcattaatgccatgtccattgagagctgagaggaggagcctcgcattcctgggaagagggacctgtccaagctgtcacactgggagtctcagatggaaggacaagtgatggggatcaggccccagagcttgctgtcccctgagaccccatcctggggagaggggaggactcctctccctacgccagccaagtttcgtcatagccagttccagctgggagagacagtgggcgtcgtccatcctcagtgagaacaccagagaacccggggccgggagaaggtggttcttcaagccgagaggcacgagctggggacagttctgcctctgtgactgctgctttgcatgaaaactcatttgatgtatattggggaaataatgagaactttatttaatttttttaagaaaaagggaaaaaaacagaaataaaacaaaaagccgccctgttaatcccgtccaacttttgtttaattctgatttctgtctcccttccatcttttctcccattcctccttctttatataatgcctatttccaaatgccagagaaagcagagatgctgagagacattggagagaaaatgactgtctccttttccttgaaattaaaaaaaaaaaaaaaaagagaaagaggagaagaagaatgatgagcacaagtatgcaccaaacacttcgcaaaaacagaggccagtaaaacctggaattatcccggcagccagaggagtatggaacttccagaactttgcacaaattgcaaagccatcaagagctcaccctggctgactggaaactgagctttatctaccacacacctgtatattctcatcttttgagaggagatgtgtacctagatagtaccaatgctttttgctactgttttttgttttgttttatttaatcctaaacctcaacaaatgaggagctggtctttgatatgtttcctttcaatttccctaaagttactatgagaagtggggtgaggtgggcctctcccagaccagacacctggcagccctgcctcatatcaatccctgtcataaaccaggcaccctggggaaacggcctggaggtgtgtgggccaggcctccacgaggttccatttgaaagttgatttggagacataggtgtttgactttggagttcactccaatcatccagtggtccctggcaattaaaaagaaaacaaaaatcaaacactgtttacagcaagcaatacttgaagagcataggttacagaagctgcagtatttattattatgctttctttctttcattctctcgtgcctggagaggggagaccacccttcgctcatatacggaagctcctgaccatctgggcctacagcacttcctcagtagaaatgactgtggcatgcccacgttactaccttctgcctctctttctgcctctcacggacttgtgagtgtgaaggacaagtggatgacttctcactggactttccttctctgtctcttctgatgatgcctaaaactatggataaccaattctcctgagtgtagattccaaacaaagagaccaaagctccatgcccaggtccaaaggccccatagaagccagtgggagtcatcgagaggaaaggcgctctgtgagtgtcaggaccttggtggccaggatagccatcagagtgtccaggcctcccacattaccttggatccgagcagccagctccaactgttctgcaagcagcactggagtcagggggtaggaggacaagtggaagcaaaggtgtgggactggggaagacaaagaggaacaagctgcccttcctcacttttcaaagggtcaggaatcctaggctatgatgctgggaagctagaccagctcctccaagagagactagaccagggtcattttctctgttattaactctgggctccagcttctccgtgccctgctttacctccaagtggttccaatttccaaaggccctgctgaccacatgtgattcccaggagagggctgggggaggggagcgcagaggtctggcttccatccttggcgtgtagctttggatcgctgtctaaccacacagcagacgttgcccggtctccccagctctagtttcttgcctgaatgcggctgacaaatgggaagagaaaagcattcagcaaaatactcaggaaacttgctgttttcattataattcacaaccagccatgccaaggccactttcttttgaaaatccacttctttaaagtttctcaggccctattagtagcctgaaggaaatactaatgactggccttccgcactaagccaaagtgtttgctcttcatagcactcaaagcttatcagcgcagagcccataatttatggagataaaaggaaaggagatataggtaagaagagtgtgaccaggagaccttatgctacctgtaaaaaagttcagcccaccccatctaacttctgagctctgtttgggtgaagattttctggccgcatggctgctcagactggcatccaggctttgctccaccaagaagttaaaggcagtcggacatctcagtagcatctctaccagcccttaactcaatgcatctacctggcatctcccagcagttacttttggagacgattcactgcccctggggcgtttccttgaaggtttgtggagagcgtggagaatgatggggcaatggccaattggagggtggagagtgaagagccggagctggctgtgagtggtttggccacatttctcaggattccatgagagacttggggaacttgggctgacaaaggaagtagcctggggcatccttaaggaaggaattaagaaaagggaaaaagctggactcaagccacgccatgagggtgaaaggttataaggccctgccccctttccagctgcccacctgttcctcctccacacctcttcgctttgggccaccaagaaccaatgaagtccacaccctttggatgagaaaaagagggagttggttggcctctcttctccctgttatccaatttgaggatattttgaccttgggtaaggatgaagtgttaaagccacagctcctctccacaagaagccattcatcttgggggaggcagagagggaagtctctctccaaagtctatccagcttcgcttcgtttcattgatctgcacaagagacaatgctctggaaaaggaagaggaccccagaagggtgcttggcaagacagaggatgctaatgggcaatggagagcactccctccagctggcccctgctgctgcctcccgtcctctgcatggggtcaggtgcttctgtgcttgctgtcctacctctctccacagcagggctctcaaaaccattttgatcccccattggcagagggttcccctctttacagagttcagtcattaaaagcatggatcagctgttaatctcattggaggagggaactgtttcctgcattcattcatctgggaaccttcttgagtagccactgtctgccagccactgctctagagatgggaaaacagcacggaacaaaaccaaggtctttcttccagcgaatttatatccttcaggaagctggttcctgccaccaacttagcaggcaacagttctcctcccctagtggcacagggtaccagttttgtaggaaaagtggtccagcaaaggaagaaagcagaccaacccagctgccttaccttattctggggccattcccccagcgatgagagctgctcttgtttctactgccaccatctcttctggctgcacttcacctgctgcttgagcttctgaccttccttcagttccaccaaatgaggacaggaaatagcagtcaagacccctggccctgctgagcgtgaaacagaagcaatggatgagtgctggacgaagaatggcctgggcagaacaaatagggagcatttgaaagcttctggctgataaatctccaggtgcatcccggttgccacgcctgcccccattaacctgctcctggtaaatactgatccagcagctgctccaggagaggccgtctttttttcccagccacgctgtgtcttgcatgagactcctggggcctgggcacagagagaaaagaattgagactcaggaggctcagtgggtgagaaaatgcaaagtggcttcacagacacagggctgtgggagcagatcgacggggaacttgggagatgaacttcagggccttccgacgccttgtctcaggaacatgctttgagaaaaatggtagcatcctttccataactcagtctctcttccctagtttccctgaagtgtgacgttttagtatctggagctcagtgatccccatgaatgagggataaagtttcactcttggtattttctaactagtgctagggaaagtcctgagacacgatcacagccactgcttggcatacagggcctccacccaataagcaaactggagattcctcagcctctcgtggacacccacatctcattcttctcacagcagagaagctctcccttcagcctgagctgtcttctttctgctgcagtgcagcctgctccctcctaccctggcctcaaggaaggtaggaaacatcttctgcatttcaaagtcctcactttgacttatttggccttcatcttggcatggaaggtggcaggcagaatggaaatactccccccaaacagaacagatattcttgcgtgtgtaagggcagaagggacaagctctctatcccatgagactaggggccggagcccacctgcctttccccacaacttttcctgctcaaacccactcctcttgacacactggaatctgtattatatatatttttaagaaaatacaatgatggttgtctggttttgttgtttttacaggtgttgtggaataaaaactgtaagaaaattaagtatttaaaatgttccaataaagtggggttttttgttattctaatatattattgtgtacctattgtaaatatgaaacactcctattttgcaagctgaggacacaatttgtactgttgttatatataaataaagtttactgaattaaaaaaaccttaaatctttaaataaa

SEQ ID NO: 166754 - DNA, 10885 bp, Homo sapiens
  Payload ID: 12829
  Gene Symbol: PLXNA3
  Gene Name: plexin A3
  Uniprot ID: P51805
  ENST ID: ENST00000369682
  CDS Start-End: 176-5791
agtgtgtgggcggcggcggcggcggctgcgcgcttggggcccggggcgcggggcgaggccgtggggacgtgcgagcggggccgcggtggggctcgggggcgcgtccacgtggccagagggcggccacccggagccagcggagggacaggcctgtccccaggcgcggctgccggccatgccctctgtctgcctcctcctgctgctcttccttgccgtggggggggccctgggcaacaggcccttccgtgccttcgtggtgacagacaccacgcttacccacctggctgtgcaccgggtgactggggaggtgttcgtgggcgcagtgaaccgagtctttaagctggcccccaacctgactgagctgcgggcccatgtcacggggcccgtcgaggacaacgctcgctgctacccgccccccagcatgcgcgtgtgtgcccaccgcctggcccccgtggacaacatcaacaagctgctgctcatagactatgcggcccgccgcctggtggcctgcggcagcatctggcagggcatctgccagttcctgcgtctggacgacctcttcaagctgggtgagccgcaccaccgcaaggagcactacctgtcgggggcccaggagcccgactccatggctggtgtcattgtggagcagggccaggggcccagcaagctgtttgtgggcactgctgtcgacggcaagtcggagtacttccccaccttgagctcccgcaagctcatcagtgatgaagacagcgcggacatgttcagtctcgtgtaccaggatgagtttgtgtcctcccagatcaagatcccctcagacacgctgtccttgtaccctgcctttgacatctactacatctacggcttcgtcagcgcctccttcgtgtacttcctgacgctgcagctggacacccagcagacgctgttggacacagcgggcgagaaatttttcacgtccaagatcgtgcgcatgtgcgcgggagactcagagttctactcatacgtggaattccccatcggctgctcctggcgcggcgtggagtaccgcttggtgcagagcgcccacctggccaagcctggcctgctgctggcccaggccctgggcgtgccggctgatgaggacgtcctcttcaccatcttctctcagggccagaagaaccgggccagcccaccccggcagaccatcctctgcctcttcaccctcagcaacatcaatgcccacatccggcgccgcatccagtcctgctatcgtggggagggcactctggctctgccctggctgctgaacaaggagctgccctgcatcaacacccccatgcagatcaacggcaacttctgtgggctggtgttgaaccagcctctgggaggcctgcatgtgatcgaggggctgcccctgctggccgacagcaccgacggcatggccagcgtggccgcctacacctaccgccagcactctgtggtcttcattggcacgcgcagcggcagcttgaagaaggtgcgggtcgatggcttccaggatgcccacctgtatgagacagtccccgtggtggatggcagccccatcctccgagacctgctcttcagcccggaccaccggcacatctatctcctgagtgagaagcaggtgagccagctcccggtggagacctgtgagcagtaccagagctgcgcagcctgcctgggctccggggacccgcactgtggttggtgtgtgctgcgacacaggtgctgccgcgaaggggcctgtctgggcgcctctgccccacacggctttgctgaggagctgagcaagtgtgtccaggtgcgggtccggcccaacaatgtgtcagtgacgtcacctggggtgcagctgaccgtcaccctgcacaacgtgccagacctcagtgcgggcgtgagctgcgccttcgaggcggcggcggagaacgaggcggtcctgctgccctccggtgaactgctctgcccctcaccctccctccaggagctccgagctcttaccagggggcatggggccacccgcactgtgcggctgcagcttctctccaaggagacaggcgtgaggtttgccggtgctgactttgtcttctacaactgcagcgtcctccagtcgtgcatgtcctgtgttggcagcccttacccctgccactggtgtaagtaccgccacacgtgtaccagccgcccccacgagtgctccttccaggagggcagggtccacagccctgagggctgccctgagatcctgcccagtggggacctcctgatccccgttggggtcatgcagcctcttaccttgcgggctaagaacctacctcagccgcagtcgggccagaagaactatgagtgcgtggtgcgggtgcaggggcggcagcagcgggtgcctgccgtgcgcttcaacagcagcagtgtgcagtgccagaacgcctcgtactcctatgaaggtgatgagcatggtgacaccgagctggacttttccgtggtctgggatggagacttccccatagacaagcctcccagcttccgagccctcctgtacaagtgctgggcgcagcggcccagctgtggcctctgcctcaaggctgatccccgcttcaactgtggctggtgcatctcagagcacaggtgccagctgcggacccactgcccggccccgaagaccaactggatgcacctgagccagaagggcacccggtgcagccacccccgcatcacgcagatccaccctctcgtggggcccaaggaaggaggcacccgggtcaccatcgtgggtgagaacctgggcctcttgtcccgagaggtgggcctgcgggtggctggcgtgcgttgcaactccattccggccgagtacatcagtgctgagaggatcgtgtgtgagatggaggagtcgctggtgcccagcccgccgccggggcccgtggagctgtgtgtgggtgactgttcagccgacttccgcacgcagtcggagcaggtctacagctttgtgaccccaacgtttgaccaagtgagtcccagccgtggcccggcgtccgggggcacacggcttaccatctcaggcagctctctggatgctggcagcagggtcacagtgactgtgagggacagcgagtgccagtttgtaaggagagatgccaaggcgatcgtgtgcatctcacctctctccaccctgggccccagccaggcccccatcacacttgccattgaccgggctaacatctccagccccgggctcatctacacctacactcaggaccccaccgtcacccgccttgagcccacctggagcatcatcaatggaagcactgccatcactgtgagtgggacccacctgctgacggtccaggagccccgggtccgtgccaagtaccgcggcattgagaccaccaatacatgccaagtgatcaacgacactgccatgctgtgtaaggcccccggcatctttcttgggcggccccagcctcgggcgcaaggcgagcaccctgatgagtttggcttcctgctggaccacgtgcaaacggcccgctccctcaaccgctcctcctttacctactaccctgatcccagctttgagccgctggggccctctggcgtgctggacgtcaaaccgggctcccacgtggtgctgaagggcaagaacctgattcccgctgcagccggcagctcccgcctcaactacactgtgctgataggaggccagccgtgttcgctcactgtctcggacacacaactcctgtgcgactcacccagccagactggccggcagcctgtcatggtgctggtgggtggcctggagttctggctgggcaccctgcacatctcggcagagcgggcgctgaccctaccggccatgatggggctggcggcggggggtgggctcctgctgctggccatcacagccgtgctggtggcctacaagcgcaagactcaggacgcggaccgtaccctcaagcgtctgcagctgcagatggacaacctggagtcccgtgtggccctggagtgcaaggaagcttttgcagagctgcagacggacatcaatgagctgactaaccacatggacgaggtgcagatccccttcctggactaccggacttacgccgtgcgcgtgctcttcccgggcatcgaggcccacccggtgctcaaggagctggatacgccacccaacgtggagaaggccctgcgcctcttcgggcagctgctgcacagccgcgcgttcgtgcttaccttcatccacacgctggaggcccagagcagcttctccatgcgcgaccgcggcaccgtggcctcgctcaccatggtggccctgcagagccggctcgactatgccacggggctgctcaagcaactgctggccgacctcatcgagaagaacctcgagagcaagaaccaccccaagctgctgctacgcaggacagagtcagtggctgagaagatgcttaccaactggttcacgttcctgctgcataagtttctgaaggagtgtgctggggagcctctcttcctgctttactgtgccatcaagcagcagatggagaagggccccattgatgccatcacgggcgaggcacgatactccctgagcgaggacaagctcatccgtcagcagatcgactacaagacactgacccttcactgcgtgtgtccggagaacgagggcagcgcccaggtcccagtgaaggttctcaactgtgacagcatcacccaggccaaagataagctgctggacactgtgtacaagggcattccgtactcccagcgtcccaaagctgaggacatggacctggagtggcgccagggccgcatgactcgcatcatcctccaggatgaggatgtcaccaccaagatcgagtgtgactggaagaggctcaactcactggcccactaccaggtgacagacggttccttggtggcattggtgcccaaacaagtgtctgcctataacatggccaactccttcaccttcacccgctccctcagccgctacgagagcttgctccgcacggccagcagccctgatagcctccgctcacgggcacccatgattacgcctgaccaggagacaggcaccaaattgtggcacctggtgaaaaaccacgaccatgccgaccatcgcgagggggaccgtggcagcaagatggtctccgagatctacctgacacggctgctggccaccaagggcacactgcagaagttcgtggatgacctctttgagacagtgttcagcacagcccaccggggctcggccctgcccctggccatcaagtacatgttcgacttcctggatgagcaggcggaccagcgccagatcagcgaccccgatgtgcgccacacctggaagagcaactgcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggagattctcacggctctggaccgagatgcctcttgtcggaagcataagttgcggcagaaactggaacagatcatcagcctcgtgtccagcgacagctaaggtggtggaatcggtgaggagggggcttctcagtcctgtgccgtcctcccatccaggggagtggctggctcaagcctgggtccccgggctgagccctggattgggtatcgtggggcaggtcaccctggccacgatgcccccggcacacccaggcccccttcattagtgccttgctttgggccctgcagggggaggggtgacagggcgagcccccaccccagcagcagcaatacccccaccctcctgccctgtgcccaggtgttgggacagtcccaccctccctgctatttatatccctctgcctatttattgaatcgaacttcgcctctgtctccatctgtaaatatgtgtccccccaccggatgtcgccaccctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacgctcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgccatccatgtggggctctgtccttggggcaggtcagtagacctgtggatgctgcatgagctggagccccattgtgggagaaaggaccactccttgcagggtcccagagggtttggggaggttcagggccatacccgacccatcagcaaaccccggtggctctaccttcaagacagattcaaggtagatagattctcctcccttccaccacccccacccagctctcctgtgccatcgtctatctctgcctggatgccagtctccctgcttctgccctggctctcttcagcctgttctcagcgtgggaggcagagagatcctgttatgatataaggtggatcatgttgcctcactgtttagaaccctccggcggtttcagctgcagccagctccttcaaaacctgacaattgcatactgtcgaggttgtggcacccatcatggtgcacctaccaaagtcttactcccaggcctgttaagtaatgcaggtggggagaaggtgacatgcaatttatttatttatttattttgagacagagtgtagctgtgttgcccaggctggagtgcagtggcaagatcacagctcagtgcagtctcaaactcctgggctcaagtgatcctcccacctcagcctcctgaatagctgggtgtattagtgcactctactatgccaggctttttttttttttttttttgagataggttgccgctatgttgttcaggctggtcttgaattcctggtctcaagtgatcctcacccctcagcctcccaaagtattgggattacaggcatgagccactgtgcccggccaggtgagatggaatcttatttttactttttatgtttttttttttttctttgacggagtgtcgctctgtcgcccaggctggagtgcagtggcatgatctcggctcactgcaagctccgcctcccaggttcacgccattctcctgcctcagcctcccgaatagctggaactacaggtgcccaccaccacgcccggctaattttttgtatttttagtagagacggggttttactgtgttagccaggatggtctcgatctcctgacctcgtgatccacctgcctcagcctcccaaagtgctgggattacaggcgtgagccaccatgcctgaccttttttttttttttttttttttttttttttggagacgggatcttgccctgttgcccacgctggagtgcagtggcaaaatcaactcactgcagccttgatgtcctgggctcaagtgatcttcctgcctcagccttctgagtagctaggattacaagtgcttgccaccatacccagctgttttttgttttttttttttttctttagtagagatggagtcttgctggttttgaacctcctgggctcaagtgatcctcctgttttggcctcccaaaattctgggattacagttgtgagccactgtgcccagccaagtgagatgcaattttttttttttttttttttgagacagagtttcactcttgttgcccaggctggagtgcaatggtatgatcttggctcaccgcaacctccgcctcccgggttcaagtgattctcctgcctcagcctcctgagtagctgagattacaggcatgtgccaccacgcccagctaattttgtatttttagtagacacagggtttctccatgttggtcaggctggtctcgagctcccgacctcaggtgatccgcccgcctcagcctcccaaagtgctgggattacaggcatgagccactgttcctggcctttcttctttttttgtttttgtttttttttgagatgcaattttaaatagggtggcttggacagccacctgagttgggtttaaaagctgccagctccagccgtccagctgtggggccacggtgccagacagtggtggtggttataggaccgtaggtgtttaccaaaactagacaagtccacataacaaccaactgcacaaataaggagtaaaataataaagagaaggacgtgtgaggcaggactggattgtagcccaggataaagagaagttgcgggatgacagctgtgccgtcggcccagacagaaccatctggacagaggacagaggataagggagatggttgaaaatactaccatcatatgataatgacaactaagccacaggaaaacaaggcagttttaacctcaggggaaatccctcagaaatggatggaatctaccagaagcatcatgagaggaagaggaagggaaacagagctaaattggggccaggtgtggtggctcgcacttgtcatcccagcacttttggaggcccaggcgggaagatcactggagcccaggagttcaggaccagcctgggcaacaaagcgagatcccctctctacaaaaaataaaaaactagccaggcatggtggtgcatgcctgtggtcccagttactcaggaggctgaggtgctggggaacaaggctgcagtgagctgtgattgtgccagcctaggtgacagagccagaccctgtatcaaaaaaaataataataattaaaaaacaaaagatcggctgggcgcggtggctcatgcctgtaatcccagcactttgggaggctgaggtgggtggaccacctgaggtcgggagttcgagaccagcctcaccaacatggagaaaccctgtgtctactaaaaatacaaaattagctgggcgtggtggtgcatgcctgtaattctagctacttgggaggctgaggcaggagaattcacttgaacccgggaagtggaggttgcggtgagccaagatcgcaccattgcactccagcctgggcaacaagagtgaaacactgtctcaaaaaaaaaaaaaaaaagtgaaagatctaaattgtcaactattcgtcaataattaatgtctaaaaaatattaagaaaggaagaaaggaatgagagcaaaagagagggagagaggaaagtgtcatcttcataagctgaaggccagtgccaccgtcaccactggcagagctccccagattctacaaagggaaactgttcctccatatggagtaatagggactggatatgtcatgccaaatgaaagaacacgccaaaccagacaaaatatatggaatgcagagtattaaaaaactggctgtgggccagtgagggacagcgacgtgtgggagctgggaaacaaggtaagccatgcgactggcccagtgtcctgtgtggagtttcctggtggagcctggcagacacccggactttaggagttgaaactgattcagagcgtcccagcagctggagtttgcagggcggagaaccagagagaagagagctgcacagggaaagaaccctggatatccacagaggctcccgttccagtgtgcagcggactacgactactggtgagcacaggcgtgtgaggaagctacccaagaccagggaaggccatcaccccagcaggagaggatgaacggtaactccagtgtgcaagcaggacagggactagcagctgtccccacccaccaggatagagaagctcatgttcacctaggcagcactggccagggtgcccagaatggtgtttgttgcctccatagagggaaacaagcctacagttaagagctgctctggtcccacacagcacatcttcaaagcaagactcaaaaggatcaaaccatttccttgttttctgagaataaaagcagttgtacctcttccttttcactctcagaaaatctgatagaatctataaaagagccctaaggctggagacactgtattttccagggagccaactccttgccccagacactagtcaattgccccagcactttcttcactgatcgttagaggaaaaaagctcatgttagatttaaaaatcaggaaaaaaatttaacactaaacttgcaaatattatgtggtgtatattacagttacacatttactatgtaagtgcaactgtaaaactgaggaagtattccaaaatgttgacagtagttaatcctgaatgacagaacccaattgattttcattttcttccatttcctaaattgtcttcaatttccttgtactccttgaatatctgaattctagaaccccccccccagcaacccaagcacaacaagaatattgggaggtgccccagctgcaaataaactcagacttggaatagta

SEQ ID NO: 166755 - DNA, 13061 bp, Homo sapiens
  Payload ID: 12830
  Gene Symbol: PLXNA4
  Gene Name: plexin A4
  Uniprot ID: Q9HCM2
  ENST ID: ENST00000321063
  CDS Start-End: 230-5914
tgcgttcggggctggggctggaggaggcagccacacgcgcgcacacgcacacgttcagaggagggcgagaggcagcggcataggctccatctgcagtgtcaatgcggcgctcccgctgaaggagggaaacgcggcgcgtccagtaggggagactgcattgctgagtcctggccctctgaggggacgactgtgcctgagtgctgctgtgccactgggacccgcctctgccatgaaagccatgccctggaactggacctgccttctctcccacctcctcatggtgggcatgggctcctccactttgctcacccggcagccagccccgctgtcccagaagcagcggtcatttgtcacattccgaggagagcccgccgagggtttcaatcacctggtggtggatgagaggacaggacacatttacttgggggccgtcaatcggatttacaagctctccagcgacctgaaggtcttggtgacgcatgagacagggccggacgaggacaaccccaagtgttacccaccccgcatcgtccagacctgcaatgagcccctgaccaccaccaacaatgtcaacaagatgctcctcatagactacaaggagaacaggctgattgcctgtgggagcctgtaccaaggcatctgcaagctgctgaggctggaggacctcttcaagctgggggagccttatcataagaaggagcactatctgtcaggtgtcaacgagagcggctcagtctttggagtgatcgtctcctacagcaacctggatgacaagctgttcattgccacggcagtggatgggaagcccgagtattttcccaccatctccagccggaaactgaccaagaactctgaggcggatggcatgttcgcgtacgtcttccatgatgagttcgtggcctcgatgattaagatcccttcggacaccttcaccatcatccctgactttgatatctactatgtctatggttttagcagtggcaactttgtctactttttgaccctccaacctgagatggtgtctccaccaggctccaccaccaaggagcaggtgtatacatccaagctcgtgaggctttgcaaggaggacacagccttcaactcctatgtagaggtgcccattggctgtgagcgcagtggggtggagtaccgcctgctgcaggctgcctacctgtccaaagcgggggccgtgcttggcaggacccttggagtccatccagatgatgacctgctcttcaccgtcttctccaagggccagaagcggaaaatgaaatccctggatgagtcggccctgtgcatcttcatcttgaagcagataaatgaccgcattaaggagcggctgcagtcttgttaccggggcgagggcacgctggacctggcctggctcaaggtgaaggacatcccctgcagcagtgcgctcttaaccattgacgataacttctgtggcctggacatgaatgctcccctgggagtgtccgacatggtgcgtggaattcccgtcttcacggaggacagggaccgcatgacgtctgtcatcgcatatgtctacaagaaccactctctggcctttgtgggcaccaaaagtggcaagctgaagaagatccgggtggatggacccaggggcaacgccctccagtatgagacggtgcaggtggtggaccccggcccagtcctccgggatatggccttctccaaggaccacgagcaactctacatcatgtcagagaggcagctcaccagagtccctgtggagtcctgtggtcagtatcagagctgcggcgagtgccttggctcaggcgacccccactgtggctggtgtgtgctgcacaacacttgcacccggaaggagcggtgtgagcggtccaaggagccccgcaggtttgcctcggagatgaagcagtgtgtccggctgacggtccatcccaacaatatctccgtctctcagtacaacgtgctgctggtcctggagacgtacaatgtcccggagctgtcagctggcgtcaactgcacctttgaggacctgtcagagatggatgggctggtcgtgggcaatcagatccagtgctactcccctgcagccaaggaggtgccccggatcatcacagagaatggggaccaccatgtcgtacagcttcagctcaaatcaaaggagaccggcatgaccttcgccagcaccagctttgtcttctacaattgcagcgtccacaattcgtgcctgtcctgcgtggagagtccataccgctgccactggtgtaaataccggcatgtctgcacccatgaccccaagacctgctccttccaggaaggccgagtgaagctgcccgaggactgcccccagctgctgcgagtggacaagatcctggtgcccgtggaggtgatcaagcctatcacgctgaaggccaagaacctcccccagccccagtctgggcagcgtggctacgaatgcatcctcaacattcagggcagcgagcagcgagtgcccgccctgcgcttcaacagctccagcgtacagtgccagaacacctcttattcctatgaagggatggagatcaacaacctgcccgtggagttgacagtcgtgtggaatgggcacttcaacattgacaacccagctcagaataaagttcacctctacaagtgtggagccatgcgtgagagctgcgggctgtgcctcaaggctgacccagacttcgcatgtggctggtgccagggcccaggccagtgcaccctgcgccagcactgccctgcccaggagagccagtggctggagctgtctggtgccaaaagcaagtgcacaaacccccgcatcacagagataatcccggtgacaggcccccgggaagggggcaccaaggtcactatccgaggggagaacctgggcctggaatttcgcgacatcgcctcccatgtcaaggttgctggcgtggagtgcagccctttagtggatggttacatccctgcagaacagatcgtgtgtgagatgggggaggccaagcccagccagcatgcaggcttcgtggagatctgcgtggctgtgtgtcggcctgaattcatggcccggtcctcacagctctattacttcatgacactgactctctcagatctgaagcccagccgggggcccatgtccggagggacccaagtgaccatcacaggcaccaacctgaatgccggaagcaacgtggtggtgatgtttggaaagcagccctgtctcttccacaggcgatctccatcctacattgtctgcaacaccacatcctcagatgaggtgctagagatgaaggtgtcggtgcaggtggacagggccaagatccaccaggacctggtctttcagtatgtggaagaccccaccatcgtgcggattgagccagaatggagcattgtcagtggaaacacacccatcgccgtatgggggacccacctggacctcatacagaacccccagatccgtgccaagcatggagggaaggagcacatcaatatctgtgaggttctgaacgctactgagatgacctgtcaggcgcccgccctcgctctgggtcctgaccaccagtcagacctgaccgagaggcccgaggagtttggcttcatcctggacaacgtccagtccctgctcatcctcaacaagaccaacttcacctactatcccaacccggtgtttgaggcctttggtccctcaggaatcctggagctcaagcctggcacgcccatcatcctaaagggcaagaacctgatcccgcctgtggctgggggcaacgtgaagctgaactacactgtgctggttggggagaagccgtgcaccgtgaccgtgtcagatgtccagctgctctgcgagtcccccaacctcatcggcaggcacaaagtgatggcccgtgtcggtggcatggagtactccccggggatggtgtacattgccccggacagcccgctcagcctgcccgccatcgtcagcatcgcagtggctggcggcctcctcatcattttcatcgtggccgtgctcattgcctataaacgcaagtcccgcgaaagtgacctcacgctgaagcggctgcagatgcagatggacaacctggagtcccgtgtggccctggagtgcaaggaagcctttgccgagctgcagacggacatccatgagctgaccagtgacctggatggagccgggattccgttcctggactatagaacttacaccatgcgggtgctgttcccaggaattgaagaccaccctgtcctccgggaccttgaggtcccgggctaccggcaggagcgtgtggagaaaggcctgaagctcttcgcccagctcatcaacaacaaggtgttcctgctgtccttcatccgcacgcttgagtcccagcgtagcttctccatgcgcgaccgtggcaacgtggcctcactcatcatgaccgtgctgcagagcaagctggagtacgccactgatgtgctgaagcagctgctggccgacctcattgacaagaacctggagagcaagaaccaccctaagctgctgctcaggaggactgagtcagtggctgagaagatgctgaccaattggtttactttcctcctctacaagttcctcaaggagtgtgctggggagcccctcttctccctgttctgtgccatcaagcagcagatggagaagggccccattgacgccatcacgggcgaggcccgctactccttgagcgaggacaagctcatccgccagcagattgactacaaaaccctggtcctgagctgtgtcagcccagacaatgccaacagccccgaggtcccagtaaagatcctcaactgtgacaccatcactcaggtcaaggagaagattctggatgccatcttcaagaatgtgccttgctcccaccggcccaaagctgcagatatggatctggagtggcgacaaggaagtggggcaaggatgatcttgcaggatgaagacatcaccaccaagattgagaatgattggaagcgactgaacacactggcccactaccaggtgccagatggttccgtggtggcattagtgtccaagcaggtgacagcctataacgcagtgaacaactccaccgtctccaggacctcagcaagtaaatatgaaaacatgatccggtacacgggcagccccgacagcctccgctcacggacacctatgatcactcctgacctggagagtggagtcaagatgtggcacctagtgaagaaccacgagcacggagaccagaaggagggggaccgggggagcaagatggtgtctgaaatctacctgacccgactcctggccactaagggcacactgcagaagtttgtggatgacctctttgagaccatcttcagcacggcacaccgtggctctgccctgcccctggccatcaagtacatgtttgacttcctggatgagcaggctgataaacatggcattcatgacccgcacgtccgccatacctggaagagcaattgcctgcccctgaggttttgggtcaacatgatcaagaacccgcagtttgtgtttgacatccataagaacagcatcacagacgcctgcctctctgtggtggctcagaccttcatggactcttgctccacgtcagagcaccggctgggcaaggactcgccctccaacaagctgctgtatgccaaggacatccccagctacaagaattgggtggagaggtattactcagacatagggaagatgccagccatcagcgaccaagacatgaacgcatacctggctgagcagtcccggatgcacatgaatgagttcaacaccatgagtgcactctcagagatcttctcctatgtgggcaaatacagcgaggagatccttggacctctggaccacgatgaccagtgtgggaagcagaaactggcctacaaactagaacaagtcataaccctcatgagcttagacagctgagaaccgtccttccagggccgccctggagggggacacaccaagccgtgcctcagtctagattatcatctttaccaagtgcaagttccgactggcatcagcagcatcccctgagcagcgctgtttctctctctttctctctgcctctttccgtttctccctccttcctggatctcttctcttccagttgctctgccaacacgattggaccaagccactgaccctcagttagtccaagaatggccaggcccatggcaagggagctgaccagaagatgtcagagaggcctctgtctcccaggtgctcctgaccctgtgcatgtcagcagcagggtgcaaataacgaatgaggagccagggacaggggacatttctgtgctgctacttcaccttccactttggcagcccctgctttggtctgagccttggcctagggaagaggcaaggaaggacttcagtattatctttactgggaagacatcacctggctctcccttcccacagttccatctccagtggttcagccagtggtctgatcgctttgcagctgtgagaagaaaggctacacctcctgcatgtggctggagcagggcatgtgtgggcagctgggaggtgctccttgaggctccttctcccccactgggctggtgtccagaggcttcctgtccttttccaggtctccagagggacctgcctgccctgcctgctcccccgccagtagaaagccaggcaggagaaagaatagcaattacattccaccatggagatgctcctgaccttttcatctgaatcctagtagcagaaatgtaacacagggggagaaaaggaaagagagttgcatctaccctggaagcagaatttgttttccatttaccctcaaattcaaatgagtcacaatcatagtcataggtctagtccactaccagagccctgagtgctgtcaagagaaagcatctatctccaccctcctttgtcaaccttcatcaagggtcaacgtgaaatgcagagtgcatctaggagattctacctccagccatctccatggctccatccccatcatccttcctgagaactccatagacggctggggccaacagcctagtccctgttccctctgcagaatccggtgccattgctatgcagatgactttgtcactgggctgtccagacctctttgggaatgatttcatcaacatctcagctgtctctcatcattctccttcctcatctcttcagcagtcatccttgaaagaaacagacttaagcaaagcctcacggagacagcccaaaatgccagccaacctcagcctccagcttgtcagatctgggagggacaaagagtcgagctgatgggcctggctggaattaagaagagggacatacaaatgaccttggccttggcatccatctccccatctgttcttacatctacagatgcacgattttagccaggcaggcaaatgtgtgcctagaaattgatactaggtaagcagaggctatggggagagatggtctaatggagggttctaggaacctttcatcctaaggagaccttaggtgctgtctggtgcagtctcccatcctaagcaggagtctctgttggcacctctgctctggagttgttcaccactatgggagacaaggagaaacatcttaggtgaggttgaggagaaggattcacagtcttgccttcactccccaaacatcagacatcattccttgtcacccactcagaatgagccccccttggggaagaaaccacaccatttccagcaaagtccatggagcatccggtacttttaagaacacttgcccctttggatatgaatatgtgcacatgtgtgtgagcacatgtatgtgtgtgtgtgtgtctgccccaggtgtaggcggaaagctcaaaaggatttcttgtcctttgtaggaggatttttgaagtgttccccttctctttccccttgctcatccattcatcctgcagcttcaggacatttcaacacttacttgctttctatgctgagagctggtgggtggaaggagagggcgcttgtccataggaaatcagggtggtcgcctgccgaggcctggaccttggaacagggcatcatgtgacatcgcagaggacagatggtggaaaagacatgagcaacctaatgggaagaggaaaatgggaaacaatgcattggaagaggaagaaaaaaaataaataaccaaaggttttggcaagtgcagtaccaggtggagaagcttgacttttctatccttgatcattttattccctcccaagaagtcagtcacaggacctggaaggccagaaagggtacatgtgggagacggtctgaggaagtacctcggtcactacaatatttttgcacatataaagggttggggaggaaagagacacaaacgtatttaacacagatttgctggatggaagctgcgtgtgtgaacgtgtgtatgagtgagtgcattttgattttttttttttttttttgcacagttaagagaaaaaatcaaacaagcagaaaaaaaaaagaaaaaagacttatcacggttctgctgaagcttttattttttactggatgatgattattgttattgttactttggcggtacaggactttattttattccatgtttttgttataagaaaaatttcaaacacctcagagaaatagaaaggttaggaagaaagaggagacaaggacagacaaattttctggctgtccccatttctcctgggggaggggtttggggctggtttgactttaattggtgggtgggttgtttctgccgctctgtttgctgcagtccccgtggcctgcttggggactgagaaatttgagccaggtatccagagccacagcccatcttgcttataaaaattatcttctgctgtttgttttccatttcttccgtttggattcttggtgcacgtgtgatatggtatttaaaagcaaagacaagcaacattgtcaaaaagctgtccttgccccccatcccccacccaaatcttttttccaaactcccccagggatcttccttaccccactggcagagcaaacatccaggggctgtccatgtggcttgcgggctcccagagaaaggaattgggccaactttgtcctgtgggatggaggccccttcacggcctccctcgaggcaaagttaatttgtagggtcaccattatgttgagtcatgagcagacagaaggagagaaaaggccatcttccttaccttcccctccaacttatcccgtaccctcccagggaaaatggtaccagactgagccatcaaaatcactgacaaagtttaggtgggaattttttttgcatgttggagagagaagggcttaaggtagcagggaagaagggggctttgtggggtcctaaattttaaggaataagtagaggaagacaagaaacagagtggtaggctggtcatttctcctggccacaagtccccccagatgcagcttttacccattctttgtccttccccataaggagagaccctgacatttcttggtagctgcaaatagtgccactaagtgaaggtggccatcatgccagttacttcctcaggaaaatattttcttgccttcttctttcagtatggttttaaatttgggaacagtggataacccaagtgtcccacaggccaaggtacattccaatggcagcatgatccctgcacccaaagccagcccctaaagcctaccccttgtgcacccgcagcctggtaagtgagcttggctgcttgtgaggagctacaagtgaaagagaagttattttaaataaatcccaaagtttgaggcagactgtccaggactgttcccaggaagaagcaggagttacccacaggaaaagtctctgacctggtcccctcaggcccagctacctgcgcccaccagcagtgaaggttgatgtactggcccagcatctccacctcccccatgcaaccaggtccctggtaccgtgtctcccgttgcatgtctggcttctgcctgtgctcctcctgccacgagcatcctccctgtccctcctcattccaccgtgtctctcctgcacacatagcctctgtcccagggcgatttatccacttgagtacaggagctgctcagacctctcagcccagccctctgtgactgccccagccccatcctaccccacccaaagctgccttcctggctgtaggagctccctcgtctagccaaggccctatgggtccccatccgaggatccacaagcaatgacttcccaaatgacctccactgcaagaagaatccttaccactgtttccagagccgtgaacgatgctgtgatgggcccaggtctcagcaccaccctctgtgacctaaaaagaaaagctcaatttccatctgtcttctttcccaggaccaaggggacacagtaatgtgaagtcaaatacttaaccgagcaaagggccagtattgttatcagtcaaggacaaacctcccacctcacagacagccaagcagtgagggaaagacagacagacataggtaggaaggtgctctgcaggcacaaggcccagagaagcccctctccgggaacttcccctgctccttccaggaacagtgagcccagtgagcagccccagccagctcttcaaggccttcaaggggtctttccatgactgagtcacctccaggagctcacctgacccccagagaagacctaccccaggcagctccgtgccctggcttctccccatgccccaaatccccccccgccatccctcctggtcctcgtctacatcaagggcctcttcccctcttcctgccagctctcaggacaggtgactgggaggccttgaaccctcagcctcttcctttaaaaaaaacaaaacaaaacaaaactgtgggccatttatttgggattttggagttgtttggtttttgtttgtatatcttaatagttcgaaagtaagaagggagccctgctatggatgttaagtccaaattactcggttagtgggagcaaaacctatgacttccaaggggatgaggagaggttcagaggacaggaggagcctcccccattgaaaaaaaaaaatgggtcaggacattccctggatgaggacaatgctaggggtggcatctcacatggctgctgctattcctggtgcttccccacacttttgacagatggagtccttctcctaccgcctcctgccacctcaccctacaggcattctctatgtaggaaacaagagccttattttatagagtggggagctgagacacagcctcaggtaacactgacacagctcccgaatgaggctgggacactctgcaaacctctcctcatggtgctaagggtggcatgctcttgacaggaaacctaaatgaccactcctctcatttggaaagtaatccactgcagtaaaagtttcagacatgcaagagagagtttttttttttttactacaaatttttgctcccccataaaattattttattagagggagtatccaagttttaaaagtatatagaattttttggttgtaagagaaatacatactcattaggatcccgattaaattccttgagtagactggtgcctaccagaaagcaaagcaaagttaaacaaaacgaaacaaaatccttcatatacaaaaagaactttctgtttgtattggcagaggtagtgaggtgattcaggtaggctgaaaatcctgggttgcgggagcctcactttattccattcccacccgctttgatgtctatgcttggctctctgggctgcccctggtactgccgaatcctacacatctcttatcagctttcctcaaactttaaggaggctctgtgagggatgggtcatgggaagacccaagctttccctccgccaggattgcaaaagcaagtagacttggtctatgcagctcttcttccagcaatttctttatttggaattagaacttcctttgttagtatctttgatcttttgactcaagcacattttggaagggctcccttacaaaagtagaatttaaaacagaggatacagttaaagagcaacccaaaggacgcttaagaaaccgagaccacttcaccaaacaggactaaggaacactttcgtgcacagaagtcagccgcaatccaggcacaggacgaagatgggatacacgtgctcatctgtctgtcctcctttcctctccctccccgacgttctagttagcttgttgacttgttaaaccttctgttcttaaaatgaaaagctagcttacctcaaagaatcttgtttccattcggaaaccaacgattttgtgttttagaatggacagccctcccctcaccactccctaccttggcctggtgtccttgagacatacggtctttgcttagtcgtgtgttggctgctttgagcaggaacaaggcctccaggccctgaggtgggaaggaaggattggatgccactgccctcctccccactttagcatgtaggggccagcccatctcttccagcagggtcctgctgagttaccatagcaaccagcaactccagggtaccacaacagacaatggctcagcgagccgacgtgtggggatgatgcaggggttttggcccagccagaggacccagagttgagcttcaaatgctagagaaggggagaaacaggatggaagggtggtttaaggaaccggcaggggtctttgagtcacatagagaagccgttgaaggaggtagggcaggttatctctgttccagtcacccccttccagccccatcccacttctgtttcaaactaaagctcccacctcgaacattgaccctttgttagaacaaagcaaagcatatctttagacaacagtgttaaaatgagcctcaaatgtatgtggatgagatctctaagaagagggtcttctggttttgatttttaaagaagagtatcctagtaaaatattaaaaaaaaattaaaaagtttttaaaaaggaaacctgtgctatttaaattggagcccagttgtaacttggtaaaggcaagcttctgtacctttgttataattaattgtatacctgtgtatgtaaatataaggcattcctattttgcagttcagaacaaaaaaaacttatttgtaatatagaataaagtttattaaaaaataataaaaatgcagtttggga

SEQ ID NO: 166756 - DNA, 13786 bp, Homo sapiens
  Payload ID: 12830
  Gene Symbol: PLXNA4
  Gene Name: plexin A4
  Uniprot ID: Q9HCM2
  ENST ID: ENST00000359827
  CDS Start-End: 964-6648
gcgagccgcggcggcagcaggcagcccgggagctccggcggcggccgagccagcggcggccccgctccctgccccctgcaaactttgcgagcagcccgcccggggggccgggggcgcgcccgggaggcccggctcggcccgcggccgagctctccgccgccgcagcgccagccgccgcagccaccaccgccgcagccccgcgcctccccggggagcagccggcggctcccgcggccccccagccccggccccagggcactgcccggcgagtgtctcggcaagggtgggggctgccgcggcgcggccggccgcgggctgccggggggcggccgccgctacccagagaggcgcgcagaggcgccgagagcgctccccggcgggtcccccgcgcactcgccgcgcccgggcagcggcccgaccgggcgagcatgggcggcgcggagtgacgccgctgtgcccgcttggcatcaaggacattcagcccgcgggggtggggacgaaggggggcagcccggcgtcgccaccgcagcccccgagagccgccgccgctgctcgggctccggggctgggtggaggaaaggggtgttcggaatcgatccccattttccgacctttttgttggacattacgcccaccttggacgccgcaagagaagctgtcaagccccgcaggctctgattcggcgccctccgcgttcctcggctgctcccggcttccctgtgcctcggtggagtatttgcgttcggggctggggctggaggaggcagccacacgcgcgcacacgcacacgttcagaggagggcgagaggcagcggcataggctccatctgcagtgtcaatgcggcgctcccgctgaaggagggaaacgcggcgcgtccaggggagactgcattgctgagtcctggccctctgaggggacgactgtgcctgagtgctgctgtgccactgggacccgcctctgccatgaaagccatgccctggaactggacctgccttctctcccacctcctcatggtgggcatgggctcctccactttgctcacccggcagccagccccgctgtcccagaagcagcggtcatttgtcacattccgaggagagcccgccgagggtttcaatcacctggtggtggatgagaggacaggacacatttacttgggggccgtcaatcggatttacaagctctccagcgacctgaaggtcttggtgacgcatgagacagggccggacgaggacaaccccaagtgttacccaccccgcatcgtccagacctgcaatgagcccctgaccaccaccaacaatgtcaacaagatgctcctcatagactacaaggagaacaggctgattgcctgtgggagcctgtaccaaggcatctgcaagctgctgaggctggaggacctcttcaagctgggggagccttatcataagaaggagcactatctgtcaggtgtcaacgagagcggctcagtctttggagtgatcgtctcctacagcaacctggatgacaagctgttcattgccacggcagtggatgggaagcccgagtattttcccaccatctccagccggaaactgaccaagaactctgaggcggatggcatgttcgcgtacgtcttccatgatgagttcgtggcctcgatgattaagatcccttcggacaccttcaccatcatccctgactttgatatctactatgtctatggttttagcagtggcaactttgtctactttttgaccctccaacctgagatggtgtctccaccaggctccaccaccaaggagcaggtgtatacatccaagctcgtgaggctttgcaaggaggacacagccttcaactcctatgtagaggtgcccattggctgtgagcgcagtggggtggagtaccgcctgctgcaggctgcctacctgtccaaagcgggggccgtgcttggcaggacccttggagtccatccagatgatgacctgctcttcaccgtcttctccaagggccagaagcggaaaatgaaatccctggatgagtcggccctgtgcatcttcatcttgaagcagataaatgaccgcattaaggagcggctgcagtcttgttaccggggcgagggcacgctggacctggcctggctcaaggtgaaggacatcccctgcagcagtgcgctcttaaccattgacgataacttctgtggcctggacatgaatgctcccctgggagtgtccgacatggtgcgtggaattcccgtcttcacggaggacagggaccgcatgacgtctgtcatcgcatatgtctacaagaaccactctctggcctttgtgggcaccaaaagtggcaagctgaagaagatccgggtggatggacccaggggcaacgccctccagtatgagacggtgcaggtggtggaccccggcccagtcctccgggatatggccttctccaaggaccacgagcaactctacatcatgtcagagaggcagctcaccagagtccctgtggagtcctgtggtcagtatcagagctgcggcgagtgccttggctcaggcgacccccactgtggctggtgtgtgctgcacaacacttgcacccggaaggagcggtgtgagcggtccaaggagccccgcaggtttgcctcggagatgaagcagtgtgtccggctgacggtccatcccaacaatatctccgtctctcagtacaacgtgctgctggtcctggagacgtacaatgtcccggagctgtcagctggcgtcaactgcacctttgaggacctgtcagagatggatgggctggtcgtgggcaatcagatccagtgctactcccctgcagccaaggaggtgccccggatcatcacagagaatggggaccaccatgtcgtacagcttcagctcaaatcaaaggagaccggcatgaccttcgccagcaccagctttgtcttctacaattgcagcgtccacaattcgtgcctgtcctgcgtggagagtccataccgctgccactggtgtaaataccggcatgtctgcacccatgaccccaagacctgctccttccaggaaggccgagtgaagctgcccgaggactgcccccagctgctgcgagtggacaagatcctggtgcccgtggaggtgatcaagcctatcacgctgaaggccaagaacctcccccagccccagtctgggcagcgtggctacgaatgcatcctcaacattcagggcagcgagcagcgagtgcccgccctgcgcttcaacagctccagcgtacagtgccagaacacctcttattcctatgaagggatggagatcaacaacctgcccgtggagttgacagtcgtgtggaatgggcacttcaacattgacaacccagctcagaataaagttcacctctacaagtgtggagccatgcgtgagagctgcgggctgtgcctcaaggctgacccagacttcgcatgtggctggtgccagggcccaggccagtgcaccctgcgccagcactgccctgcccaggagagccagtggctggagctgtctggtgccaaaagcaagtgcacaaacccccgcatcacagagataatcccggtgacaggcccccgggaagggggcaccaaggtcactatccgaggggagaacctgggcctggaatttcgcgacatcgcctcccatgtcaaggttgctggcgtggagtgcagccctttagtggatggttacatccctgcagaacagatcgtgtgtgagatgggggaggccaagcccagccagcatgcaggcttcgtggagatctgcgtggctgtgtgtcggcctgaattcatggcccggtcctcacagctctattacttcatgacactgactctctcagatctgaagcccagccgggggcccatgtccggagggacccaagtgaccatcacaggcaccaacctgaatgccggaagcaacgtggtggtgatgtttggaaagcagccctgtctcttccacaggcgatctccatcctacattgtctgcaacaccacatcctcagatgaggtgctagagatgaaggtgtcggtgcaggtggacagggccaagatccaccaggacctggtctttcagtatgtggaagaccccaccatcgtgcggattgagccagaatggagcattgtcagtggaaacacacccatcgccgtatgggggacccacctggacctcatacagaacccccagatccgtgccaagcatggagggaaggagcacatcaatatctgtgaggttctgaacgctactgagatgacctgtcaggcgcccgccctcgctctgggtcctgaccaccagtcagacctgaccgagaggcccgaggagtttggcttcatcctggacaacgtccagtccctgctcatcctcaacaagaccaacttcacctactatcccaacccggtgtttgaggcctttggtccctcaggaatcctggagctcaagcctggcacgcccatcatcctaaagggcaagaacctgatcccgcctgtggctgggggcaacgtgaagctgaactacactgtgctggttggggagaagccgtgcaccgtgaccgtgtcagatgtccagctgctctgcgagtcccccaacctcatcggcaggcacaaagtgatggcccgtgtcggtggcatggagtactccccggggatggtgtacattgccccggacagcccgctcagcctgcccgccatcgtcagcatcgcagtggctggcggcctcctcatcattttcatcgtggccgtgctcattgcctataaacgcaagtcccgcgaaagtgacctcacgctgaagcggctgcagatgcagatggacaacctggagtcccgtgtggccctggagtgcaaggaagcctttgccgagctgcagacggacatccatgagctgaccagtgacctggatggagccgggattccgttcctggactatagaacttacaccatgcgggtgctgttcccaggaattgaagaccaccctgtcctccgggaccttgaggtcccgggctaccggcaggagcgtgtggagaaaggcctgaagctcttcgcccagctcatcaacaacaaggtgttcctgctgtccttcatccgcacgcttgagtcccagcgtagcttctccatgcgcgaccgtggcaacgtggcctcactcatcatgaccgtgctgcagagcaagctggagtacgccactgatgtgctgaagcagctgctggccgacctcattgacaagaacctggagagcaagaaccaccctaagctgctgctcaggaggactgagtcagtggctgagaagatgctgaccaattggtttactttcctcctctacaagttcctcaaggagtgtgctggggagcccctcttctccctgttctgtgccatcaagcagcagatggagaagggccccattgacgccatcacgggcgaggcccgctactccttgagcgaggacaagctcatccgccagcagattgactacaaaaccctggtcctgagctgtgtcagcccagacaatgccaacagccccgaggtcccagtaaagatcctcaactgtgacaccatcactcaggtcaaggagaagattctggatgccatcttcaagaatgtgccttgctcccaccggcccaaagctgcagatatggatctggagtggcgacaaggaagtggggcaaggatgatcttgcaggatgaagacatcaccaccaagattgagaatgattggaagcgactgaacacactggcccactaccaggtgccagatggttccgtggtggcattagtgtccaagcaggtgacagcctataacgcagtgaacaactccaccgtctccaggacctcagcaagtaaatatgaaaacatgatccggtacacgggcagccccgacagcctccgctcacggacacctatgatcactcctgacctggagagtggagtcaagatgtggcacctagtgaagaaccacgagcacggagaccagaaggagggggaccgggggagcaagatggtgtctgaaatctacctgacccgactcctggccactaagggcacactgcagaagtttgtggatgacctctttgagaccatcttcagcacggcacaccgtggctctgccctgcccctggccatcaagtacatgtttgacttcctggatgagcaggctgataaacatggcattcatgacccgcacgtccgccatacctggaagagcaattgcctgcccctgaggttttgggtcaacatgatcaagaacccgcagtttgtgtttgacatccataagaacagcatcacagacgcctgcctctctgtggtggctcagaccttcatggactcttgctccacgtcagagcaccggctgggcaaggactcgccctccaacaagctgctgtatgccaaggacatccccagctacaagaattgggtggagaggtattactcagacatagggaagatgccagccatcagcgaccaagacatgaacgcatacctggctgagcagtcccggatgcacatgaatgagttcaacaccatgagtgcactctcagagatcttctcctatgtgggcaaatacagcgaggagatccttggacctctggaccacgatgaccagtgtgggaagcagaaactggcctacaaactagaacaagtcataaccctcatgagcttagacagctgagaaccgtccttccagggccgccctggagggggacacaccaagccgtgcctcagtctagattatcatctttaccaagtgcaagttccgactggcatcagcagcatcccctgagcagcgctgtttctctctctttctctctgcctctttccgtttctccctccttcctggatctcttctcttccagttgctctgccaacacgattggaccaagccactgaccctcagttagtccaagaatggccaggcccatggcaagggagctgaccagaagatgtcagagaggcctctgtctcccaggtgctcctgaccctgtgcatgtcagcagcagggtgcaaataacgaatgaggagccagggacaggggacatttctgtgctgctacttcaccttccactttggcagcccctgctttggtctgagccttggcctagggaagaggcaaggaaggacttcagtattatctttactgggaagacatcacctggctctcccttcccacagttccatctccagtggttcagccagtggtctgatcgctttgcagctgtgagaagaaaggctacacctcctgcatgtggctggagcagggcatgtgtgggcagctgggaggtgctccttgaggctccttctcccccactgggctggtgtccagaggcttcctgtccttttccaggtctccagagggacctgcctgccctgcctgctcccccgccagtagaaagccaggcaggagaaagaatagcaattacattccaccatggagatgctcctgaccttttcatctgaatcctagtagcagaaatgtaacacagggggagaaaaggaaagagagttgcatctaccctggaagcagaatttgttttccatttaccctcaaattcaaatgagtcacaatcatagtcataggtctagtccactaccagagccctgagtgctgtcaagagaaagcatctatctccaccctcctttgtcaaccttcatcaagggtcaacgtgaaatgcagagtgcatctaggagattctacctccagccatctccatggctccatccccatcatccttcctgagaactccatagacggctggggccaacagcctagtccctgttccctctgcagaatccggtgccattgctatgcagatgactttgtcactgggctgtccagacctctttgggaatgatttcatcaacatctcagctgtctctcatcattctccttcctcatctcttcagcagtcatccttgaaagaaacagacttaagcaaagcctcacggagacagcccaaaatgccagccaacctcagcctccagcttgtcagatctgggagggacaaagagtcgagctgatgggcctggctggaattaagaagagggacatacaaatgaccttggccttggcatccatctccccatctgttcttacatctacagatgcacgattttagccaggcaggcaaatgtgtgcctagaaattgatactaggtaagcagaggctatggggagagatggtctaatggagggttctaggaacctttcatcctaaggagaccttaggtgctgtctggtgcagtctcccatcctaagcaggagtctctgttggcacctctgctctggagttgttcaccactatgggagacaaggagaaacatcttaggtgaggttgaggagaaggattcacagtcttgccttcactccccaaacatcagacatcattccttgtcacccactcagaatgagccccccttggggaagaaaccacaccatttccagcaaagtccatggagcatccggtacttttaagaacacttgcccctttggatatgaatatgtgcacatgtgtgtgagcacatgtatgtgtgtgtgtgtgtctgccccaggtgtaggcggaaagctcaaaaggatttcttgtcctttgtaggaggatttttgaagtgttccccttctctttccccttgctcatccattcatcctgcagcttcaggacatttcaacacttacttgctttctatgctgagagctggtgggtggaaggagagggcgcttgtccataggaaatcagggtggtcgcctgccgaggcctggaccttggaacagggcatcatgtgacatcgcagaggacagatggtggaaaagacatgagcaacctaatgggaagaggaaaatgggaaacaatgcattggaagaggaagaaaaaaaataaataaccaaaggttttggcaagtgcagtaccaggtggagaagcttgacttttctatccttgatcattttattccctcccaagaagtcagtcacaggacctggaaggccagaaagggtacatgtgggagacggtctgaggaagtacctcggtcactacaatatttttgcacatataaagggttggggaggaaagagacacaaacgtatttaacacagatttgctggatggaagctgcgtgtgtgaacgtgtgtatgagtgagtgcattttgattttttttttttttttttgcacagttaagagaaaaaatcaaacaagcagaaaaaaaaaagaaaaaagacttatcacggttctgctgaagcttttattttttactggatgatgattattgttattgttactttggcggtacaggactttattttattccatgtttttgttataagaaaaatttcaaacacctcagagaaatagaaaggttaggaagaaagaggagacaaggacagacaaattttctggctgtccccatttctcctgggggaggggtttggggctggtttgactttaattggtgggtgggttgtttctgccgctctgtttgctgcagtccccgtggcctgcttggggactgagaaatttgagccaggtatccagagccacagcccatcttgcttataaaaattatcttctgctgtttgttttccatttcttccgtttggattcttggtgcacgtgtgatatggtatttaaaagcaaagacaagcaacattgtcaaaaagctgtccttgccccccatcccccacccaaatcttttttccaaactcccccagggatcttccttaccccactggcagagcaaacatccaggggctgtccatgtggcttgcgggctcccagagaaaggaattgggccaactttgtcctgtgggatggaggccccttcacggcctccctcgaggcaaagttaatttgtagggtcaccattatgttgagtcatgagcagacagaaggagagaaaaggccatcttccttaccttcccctccaacttatcccgtaccctcccagggaaaatggtaccagactgagccatcaaaatcactgacaaagtttaggtgggaattttttttgcatgttggagagagaagggcttaaggtagcagggaagaagggggctttgtggggtcctaaattttaaggaataagtagaggaagacaagaaacagagtggtaggctggtcatttctcctggccacaagtccccccagatgcagcttttacccattctttgtccttccccataaggagagaccctgacatttcttggtagctgcaaatagtgccactaagtgaaggtggccatcatgccagttacttcctcaggaaaatattttcttgccttcttctttcagtatggttttaaatttgggaacagtggataacccaagtgtcccacaggccaaggtacattccaatggcagcatgatccctgcacccaaagccagcccctaaagcctaccccttgtgcacccgcagcctggtaagtgagcttggctgcttgtgaggagctacaagtgaaagagaagttattttaaataaatcccaaagtttgaggcagactgtccaggactgttcccaggaagaagcaggagttacccacaggaaaagtctctgacctggtcccctcaggcccagctacctgcgcccaccagcagtgaaggttgatgtactggcccagcatctccacctcccccatgcaaccaggtccctggtaccgtgtctcccgttgcatgtctggcttctgcctgtgctcctcctgccacgagcatcctccctgtccctcctcattccaccgtgtctctcctgcacacatagcctctgtcccagggcgatttatccacttgagtacaggagctgctcagacctctcagcccagccctctgtgactgccccagccccatcctaccccacccaaagctgccttcctggctgtaggagctccctcgtctagccaaggccctatgggtccccatccgaggatccacaagcaatgacttcccaaatgacctccactgcaagaagaatccttaccactgtttccagagccgtgaacgatgctgtgatgggcccaggtctcagcaccaccctctgtgacctaaaaagaaaagctcaatttccatctgtcttctttcccaggaccaaggggacacagtaatgtgaagtcaaatacttaaccgagcaaagggccagtattgttatcagtcaaggacaaacctcccacctcacagacagccaagcagtgagggaaagacagacagacataggtaggaaggtgctctgcaggcacaaggcccagagaagcccctctccgggaacttcccctgctccttccaggaacagtgagcccagtgagcagccccagccagctcttcaaggccttcaaggggtctttccatgactgagtcacctccaggagctcacctgacccccagagaagacctaccccaggcagctccgtgccctggcttctccccatgccccaaatccccccccgccatccctcctggtcctcgtctacatcaagggcctcttcccctcttcctgccagctctcaggacaggtgactgggaggccttgaaccctcagcctcttcctttaaaaaaaacaaaacaaaacaaaactgtgggccatttatttgggattttggagttgtttggtttttgtttgtatatcttaatagttcgaaagtaagaagggagccctgctatggatgttaagtccaaattactcggttagtgggagcaaaacctatgacttccaaggggatgaggagaggttcagaggacaggaggagcctcccccattgaaaaaaaaaaatgggtcaggacattccctggatgaggacaatgctaggggtggcatctcacatggctgctgctattcctggtgcttccccacacttttgacagatggagtccttctcctaccgcctcctgccacctcaccctacaggcattctctatgtaggaaacaagagccttattttatagagtggggagctgagacacagcctcaggtaacactgacacagctcccgaatgaggctgggacactctgcaaacctctcctcatggtgctaagggtggcatgctcttgacaggaaacctaaatgaccactcctctcatttggaaagtaatccactgcagtaaaagtttcagacatgcaagagagagtttttttttttttactacaaatttttgctcccccataaaattattttattagagggagtatccaagttttaaaagtatatagaattttttggttgtaagagaaatacatactcattaggatcccgattaaattccttgagtagactggtgcctaccagaaagcaaagcaaagttaaacaaaacgaaacaaaatccttcatatacaaaaagaactttctgtttgtattggcagaggtagtgaggtgattcaggtaggctgaaaatcctgggttgcgggagcctcactttattccattcccacccgctttgatgtctatgcttggctctctgggctgcccctggtactgccgaatcctacacatctcttatcagctttcctcaaactttaaggaggctctgtgagggatgggtcatgggaagacccaagctttccctccgccaggattgcaaaagcaagtagacttggtctatgcagctcttcttccagcaatttctttatttggaattagaacttcctttgttagtatctttgatcttttgactcaagcacattttggaagggctcccttacaaaagtagaatttaaaacagaggatacagttaaagagcaacccaaaggacgcttaagaaaccgagaccacttcaccaaacaggactaaggaacactttcgtgcacagaagtcagccgcaatccaggcacaggacgaagatgggatacacgtgctcatctgtctgtcctcctttcctctccctccccgacgttctagttagcttgttgacttgttaaaccttctgttcttaaaatgaaaagctagcttacctcaaagaatcttgtttccattcggaaaccaacgattttgtgttttagaatggacagccctcccctcaccactccctaccttggcctggtgtccttgagacatacggtctttgcttagtcgtgtgttggctgctttgagcaggaacaaggcctccaggccctgaggtgggaaggaaggattggatgccactgccctcctccccactttagcatgtaggggccagcccatctcttccagcagggtcctgctgagttaccatagcaaccagcaactccagggtaccacaacagacaatggctcagcgagccgacgtgtggggatgatgcaggggttttggcccagccagaggacccagagttgagcttcaaatgctagagaaggggagaaacaggatggaagggtggtttaaggaaccggcaggggtctttgagtcacatagagaagccgttgaaggaggtagggcaggttatctctgttccagtcacccccttccagccccatcccacttctgtttcaaactaaagctcccacctcgaacattgaccctttgttagaacaaagcaaagcatatctttagacaacagtgttaaaatgagcctcaaatgtatgtggatgagatctctaagaagagggtcttctggttttgatttttaaagaagagtatcctagtaaaatattaaaaaaaaattaaaaagtttttaaaaaggaaacctgtgctatttaaattggagcccagttgtaacttggtaaaggcaagcttctgtacctttgttataattaattgtatacctgtgtatgtaaatataaggcattcctattttgcagttcagaacaaaaaaaacttatttgtaatatagaataaagtttattaaaaaataataaaaatgc

SEQ ID NO: 166757 - DNA, 2004 bp, Homo sapiens
  Payload ID: 12830
  Gene Symbol: PLXNA4
  Gene Name: plexin A4
  Uniprot ID: Q9HCM2
  ENST ID: ENST00000378539
  CDS Start-End: 378-1946
atgagatgcagaccacatggagaccttaatgcatggagatcttgcccactagtagcgtggcccagcgttttgggacacagcccaatcagaccagtatttcccctctggagctggattgaggagggaacatggggactgaaaccttgaatgcttctgctttaattaccccgaaaagcaagtgccactgttagaaatggaaatcaggccagctgctggggcggcaagcagcaggaatgcaaatgtccatgacccctcagatccacacaaagccttctgaccttggaatttaagtaggggagactgcattgctgagtcctggccctctgaggggacgactgtgcctgagtgctgctgtgccactgggacccgcctctgccatgaaagccatgccctggaactggacctgccttctctcccacctcctcatggtgggcatgggctcctccactttgctcacccggcagccagccccgctgtcccagaagcagcggtcatttgtcacattccgaggagagcccgccgagggtttcaatcacctggtggtggatgagaggacaggacacatttacttgggggccgtcaatcggatttacaagctctccagcgacctgaaggtcttggtgacgcatgagacagggccggacgaggacaaccccaagtgttacccaccccgcatcgtccagacctgcaatgagcccctgaccaccaccaacaatgtcaacaagatgctcctcatagactacaaggagaacaggctgattgcctgtgggagcctgtaccaaggcatctgcaagctgctgaggctggaggacctcttcaagctgggggagccttatcataagaaggagcactatctgtcaggtgtcaacgagagcggctcagtctttggagtgatcgtctcctacagcaacctggatgacaagctgttcattgccacggcagtggatgggaagcccgagtattttcccaccatctccagccggaaactgaccaagaactctgaggcggatggcatgttcgcgtacgtcttccatgatgagttcgtggcctcgatgattaagatcccttcggacaccttcaccatcatccctgactttgatatctactatgtctatggttttagcagtggcaactttgtctactttttgaccctccaacctgagatggtgtctccaccaggctccaccaccaaggagcaggtgtatacatccaagctcgtgaggctttgcaaggaggacacagccttcaactcctatgtagaggtgcccattggctgtgagcgcagtggggtggagtaccgcctgctgcaggctgcctacctgtccaaagcgggggccgtgcttggcaggacccttggagtccatccagatgatgacctgctcttcaccgtcttctccaagggccagaagcggaaaatgaaatccctggatgagtcggccctgtgcatcttcatcttgaagcagataaatgaccgcattaaggagcggctgcagtcttgttaccggggcgagggcacgctggacctggcctggctcaaggtgaaggacatcccctgcagcagtgcgctcttaaccattgacgataacttctgtggcctggacatgaatgctcccctgggagtgtccgacatggtgcgtggaattcccgtcttcacggaggacagggaccgcatgacgtctgtcatcgcatatgtctacaagaaccactctctggcctttgtgggcaccaaaagtggcaagctgaagaagtccttcggcacaggtccacaagggggaatcacccaggagtggattggagtggagggagacccacctggggcgaacattgcttctcaggaacagatgctgtgtgtgtatcttcagtgctcaagtcacaaagcaatatcagatcagagagtccagcctctgctttgttgcttcctaaatgtacctgggaattcttcctaaaattactctggaaatttgaatccactttaactaaaaataaatattcatagcacagaaa

SEQ ID NO: 166758 - DNA, 3314 bp, Homo sapiens
  Payload ID: 12830
  Gene Symbol: PLXNA4
  Gene Name: plexin A4
  Uniprot ID: Q9HCM2
  ENST ID: ENST00000423507
  CDS Start-End: 136-1614
agtgtcaatgcggcgctcccgctgaaggagggaaacgcggcgcgtccagtaggggagactgcattgctgagtcctggccctctgaggggacgactgtgcctgagtgctgctgtgccactgggacccgcctctgccatgaaagccatgccctggaactggacctgccttctctcccacctcctcatggtgggcatgggctcctccactttgctcacccggcagccagccccgctgtcccagaagcagcggtcatttgtcacattccgaggagagcccgccgagggtttcaatcacctggtggtggatgagaggacaggacacatttacttgggggccgtcaatcggatttacaagctctccagcgacctgaaggtcttggtgacgcatgagacagggccggacgaggacaaccccaagtgttacccaccccgcatcgtccagacctgcaatgagcccctgaccaccaccaacaatgtcaacaagatgctcctcatagactacaaggagaacaggctgattgcctgtgggagcctgtaccaaggcatctgcaagctgctgaggctggaggacctcttcaagctgggggagccttatcataagaaggagcactatctgtcaggtgtcaacgagagcggctcagtctttggagtgatcgtctcctacagcaacctggatgacaagctgttcattgccacggcagtggatgggaagcccgagtattttcccaccatctccagccggaaactgaccaagaactctgaggcggatggcatgttcgcgtacgtcttccatgatgagttcgtggcctcgatgattaagatcccttcggacaccttcaccatcatccctgactttgatatctactatgtctatggttttagcagtggcaactttgtctactttttgaccctccaacctgagatggtgtctccaccaggctccaccaccaaggagcaggtgtatacatccaagctcgtgaggctttgcaaggaggacacagccttcaactcctatgtagaggtgcccattggctgtgagcgcagtggggtggagtaccgcctgctgcaggctgcctacctgtccaaagcgggggccgtgcttggcaggacccttggagtccatccagatgatgacctgctcttcaccgtcttctccaagggccagaagcggaaaatgaaatccctggatgagtcggccctgtgcatcttcatcttgaagcagataaatgaccgcattaaggagcggctgcagtcttgttaccggggcgagggcacgctggacctggcctggctcaaggtgaaggacatcccctgcagcagtgcgctcttaaccattgacgataacttctgtggcctggacatgaatgctcccctgggagtgtccgacatggtgcgtggaattcccgtcttcacggaggacagggaccgcatgacgtctgtcatcgcatatgtctacaagaaccactctctggcctttgtgggcaccaaaagtggcaagctgaagaagatgcctggtaccagcctctgccctacccttgagctacagacgggaccccgatcccacagagcaacagtgactctggaactcctgttctccagctgttcatcaaactgagaaaaacttcagagctgtgtaggcttatttagtgtgttgtcagccttggatattggaaaatggaaacagatgagacacatctacctccctgtgaccccagccatacatcatagctcatgtcctgccaccccaagtccttagggaaaaaagactttggagaatgtgtctctgcttagcttggctaggtagttggtctcttttctctgccccaagcgtcccatgggtaattttggacaatggagtgtaggcatgtttgactcttgtggtgttatcacttgtatatgtcagtgaaactaactgattctcccatcggaatatagttatctcttgggcctgatatatggtaggataaccttatgctcatctgtccacttctgcagccaagtcgcctggccagtgtgtgtgtgtgtgtgtgtgtgtgtgtgtgtgtgtgtgtgtgtgtatgcttatctgtgtttaaaggtgtgtgtgcatacacagggcagagaggatggagcccaccgtactgcagcatcatgtaattaactcagtgctcagaaccatcccagcctctgcgggaaagagaaaaggaagccaacagtgcctgatgagctgatcatatgtgcaaaagctctgttggcatctggtccaggagagcacccaaaaaaagttaattggtgttgtccagtctcctttccttaagactatggttacaacaaagcgtgagcagtgtctcctgcatggccactatccagcacaattccataattcccccatagagccggtggggaggaggaggtgagtggcgaaggaagtggaaacacttggtgtcatgtgctcctatcatttctactagcttactgggaaataaagtgtagtcaagagtgtatgaaggcaagatgtaaaattagcgactggtgctaatctggttacttgaaaacaagtgaaagtgctgtagatttgttctgttgctaagaaccaccacactaaacctcgtatagttcctggaggatacacaacagtgtaattctctttagggtgtgccacaggttcctggcctgtgggagggaatgaatcaggagggctcttgagaaccttcatctgtgtgcttgcactgaaagtgagtcccaaagctggagatttagtgagagcaggcaacccctctgtgtctcactgtccatattctggaggcagaggtttgtaacaggccatgtgcacctgcatagggatgggtaaagcaaggactttgaaagagttgaaaagcattataaacagttgttcagaaatacgtcccaggagttccatgtgaaactggctctgtgtgcattgaagcatggctgttgggaattctaactggtccaacactcctgcaaaacaatgtgtaaatatttaggaagaaacttgaaaatagtcaaatcctttgaactggtgacaattttttaaagaatcaattctaatttgtttcaagggtaataatcaccaagatacacatttcagcatttatttagtctatcaaaaattggaattgatatatacactcatttataggagaatggttaggtagatttggtatatttatgtagtcattgaaaacttagtttataaaggccaatcttgtaactgattcttgtgtgataacattcagtgaaaaagcatgagacaattagaaagcatgatacaatgaataaaataaaaactggaaagagaaccatcaaaatgct

SEQ ID NO: 166759 - DNA, 7143 bp, Homo sapiens
  Payload ID: 12831
  Gene Symbol: PLXNB1
  Gene Name: plexin B1
  Uniprot ID: O43157
  ENST ID: ENST00000296440
  CDS Start-End: 104-6511
agggccaggtgcgcaggggagaaacaaggcgccttggagttcaggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtggacccagcccctccccacccacagcccccaaagccctggccacccctgctcctgacacccttcccgtggagcctggggctccctccacagccacagcttcggacatctcacctggggctagtccttccctgctcagcccctgggggccatgggcaggttctggctccatatcttcccctggctccacagggtcgcctctccatgaggagccctcccctcccagcccccaaaatggacctggaaccgctgtccctgcccccactgacttcagaccctcagccacacctgaggacctcttggcctccccgctgtcaccctcagaggtagcagcagtgccccctgcagaccctggccccgaggctcttcatcccacagtgcccctggacctgccccctgccactgttcctgccaccactttcccaggggccatgggctccgtgaagcccgccctggactggctcacgagagaaggcggcgagctgcccgaggcggacgagtggacggggggtgacgcacccgccttctccacttccaccctcctctcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 166760 - DNA, 7308 bp, Homo sapiens
  Payload ID: 12831
  Gene Symbol: PLXNB1
  Gene Name: plexin B1
  Uniprot ID: O43157
  ENST ID: ENST00000358536
  CDS Start-End: 271-6678
gcccggccgacgcggctttgtctcctttgttcccggcggtggcagcgccgcgcgggaggggcgggcagcgggcgcagttttccgcccctcggtctccgggtaacagctgcggctccgccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtggacccagcccctccccacccacagcccccaaagccctggccacccctgctcctgacacccttcccgtggagcctggggctccctccacagccacagcttcggacatctcacctggggctagtccttccctgctcagcccctgggggccatgggcaggttctggctccatatcttcccctggctccacagggtcgcctctccatgaggagccctcccctcccagcccccaaaatggacctggaaccgctgtccctgcccccactgacttcagaccctcagccacacctgaggacctcttggcctccccgctgtcaccctcagaggtagcagcagtgccccctgcagaccctggccccgaggctcttcatcccacagtgcccctggacctgccccctgccactgttcctgccaccactttcccaggggccatgggctccgtgaagcccgccctggactggctcacgagagaaggcggcgagctgcccgaggcggacgagtggacggggggtgacgcacccgccttctccacttccaccctcctctcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactg

SEQ ID NO: 166761 - DNA, 3863 bp, Homo sapiens
  Payload ID: 12831
  Gene Symbol: PLXNB1
  Gene Name: plexin B1
  Uniprot ID: O43157
  ENST ID: ENST00000449094
  CDS Start-End: 1-2190
atgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccct

SEQ ID NO: 166762 - DNA, 5859 bp, Homo sapiens
  Payload ID: 12831
  Gene Symbol: PLXNB1
  Gene Name: plexin B1
  Uniprot ID: O43157
  ENST ID: ENST00000456774
  CDS Start-End: 1-5859
atgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctatag

SEQ ID NO: 166763 - DNA, 6335 bp, Homo sapiens
  Payload ID: 12832
  Gene Symbol: PLXNB2
  Gene Name: plexin B2
  Uniprot ID: O15031
  ENST ID: ENST00000359337
  CDS Start-End: 94-5610
ccttggcggcggacgtgcagagaatctcgatgctggcctggagcagaaactgagctggaccactggagcctcggtgagggggtgcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatccctgagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagcttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgaccaggacatgaacacacacctggcagagatttcccgggcgcacacggactccttgaacaccctcgtggcactccaccagctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctccagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactctg

SEQ ID NO: 166764 - DNA, 609 bp, Homo sapiens
  Payload ID: 12832
  Gene Symbol: PLXNB2
  Gene Name: plexin B2
  ENST ID: ENST00000425954
  CDS Start-End: 125-609
cagcgccgagcgcggcccgggcgccatcgagccttggcggcggacgtgcagagaatctcgatgctggcctggagcagaaactgagctggaccactggagcctcggtgagggggtgcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcc

SEQ ID NO: 166765 - DNA, 1620 bp, Homo sapiens
  Payload ID: 12832
  Gene Symbol: PLXNB2
  Gene Name: plexin B2
  ENST ID: ENST00000432455
  CDS Start-End: 190-1620
atgtcctgtcctgatgagttggtggttcctgctgtagccatcggcctcgtgtgccccgagcgcctggcggtgcccacccctcccacaggaggtcctcaggaagcacggagacatcgagaatctcgatgctggcctggagcagaaactgagctggaccactggagcctcggtgagggggtgcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccag

SEQ ID NO: 166766 - DNA, 704 bp, Homo sapiens
  Payload ID: 12832
  Gene Symbol: PLXNB2
  Gene Name: plexin B2
  ENST ID: ENST00000411680
  CDS Start-End: 1-704
tacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacag

SEQ ID NO: 166767 - DNA, 567 bp, Homo sapiens
  Payload ID: 12832
  Gene Symbol: PLXNB2
  Gene Name: plexin B2
  ENST ID: ENST00000427829
  CDS Start-End: 1-567
acgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccaggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccg

SEQ ID NO: 166768 - DNA, 6383 bp, Homo sapiens
  Payload ID: 12832
  Gene Symbol: PLXNB2
  Gene Name: plexin B2
  Uniprot ID: O15031
  ENST ID: ENST00000449103
  CDS Start-End: 142-5658
atggcagcagcgcgggccagagcgcagcgccgagcgcggcccgggcgccatcgagccttggcggcggacgtgcagagaatctcgatgctggcctggagcagaaactgagctggaccactggagcctcgggtgcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatccctgagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagcttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgaccaggacatgaacacacacctggcagagatttcccgggcgcacacggactccttgaacaccctcgtggcactccaccagctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctccagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactctg

SEQ ID NO: 166769 - DNA, 253 bp, Homo sapiens
  Payload ID: 12832
  Gene Symbol: PLXNB2
  Gene Name: plexin B2
  ENST ID: ENST00000434732
  CDS Start-End: 1-253
agacagatgtgaacttccagggcaagaacctggacaccgtgaaggtgtggatgagtggtggaggtggccgtgggaaacccacagaggacgttcagaggcttctgcagacacagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaa

SEQ ID NO: 166770 - DNA, 1387 bp, Homo sapiens
  Payload ID: 12832
  Gene Symbol: PLXNB2
  Gene Name: plexin B2
  ENST ID: ENST00000614805
  CDS Start-End: 347-1387
cccagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatccctgagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgcggcccaggccagacagcgtggtcctggagtggcgtccgggctccacagcgcagatccgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggagcgccatgcctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctggcacgcggtgccacctgcagtcaagtacttcttcgacttcctggacgagcaggcagagaagcacaacatccaggatgaagacaccatccacatctggaagacgaacagcttaccgctccggttctgggtgaacatcctcaagaacccccacttcatctttgacgtgcatgtcacgaggtggtggacgcctcgctgtcagtcatcgcgcaga

SEQ ID NO: 166771 - DNA, 3443 bp, Homo sapiens
  Payload ID: 12832
  Gene Symbol: PLXNB2
  Gene Name: plexin B2
  ENST ID: ENST00000610984
  CDS Start-End: 1790-2272
acggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatccctgagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcctgggcacgcggtgccacctgcagtcaagtacttcttcgacttcctggacgagcaggcagagaagcacaacatccaggatgaagacaccatccacatctggaagacgaacagcttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgaccaggacatgaacacacacctggcagagatttcccgggcgcacacggactccttgaacaccctcgtggcactccaccagctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctccagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactctg

SEQ ID NO: 166772 - DNA, 6146 bp, Homo sapiens
  Payload ID: 12833
  Gene Symbol: PLXNB3
  Gene Name: plexin B3
  Uniprot ID: Q9ULL4
  ENST ID: ENST00000361971
  CDS Start-End: 115-5844
gctcctggcaccgccagctgctacttggccctcgccggtggcccaccaggacaatgcccccccgcagccatctcatgcccatcgccactgccctggggcagctgaactgagcgtatgtgccacgccgcccaggagacccctctgctgcaccacttcatggcccccgtgatggctcgctggcctcccttcggcctctgcctcctcctgctgctgctgtccccaccgccactgcccttgacaggggcccatcgcttctccgcacctaataccactctcaaccacttggcactggcacctggccgaggcacactctatgtcggcgcagtgaaccgcctcttccagctcagccccgagctgcagctcgaggccgtggctgtcactggccctgtaatcgacagccctgactgcgtgcccttccgtgacccagccgagtgcccacaggcccagctcactgacaatgccaaccagctgctgctggtgagcagccgcgcccaggagctggtggcctgcgggcaggtgcggcagggcgtgtgtgagacacggcgccttggggatgtggccgaggtgctgtaccaggctgaggaccctggtgacgggcagtttgtggctgccaataccccgggagtggcaacggtggggctggtggtgcccttgcccggccgggacctcctgcttgtggccagaggcctggcgggcaagctgtcggcaggggtgccacccctggccatccgccagctggccgggtctcagcccttctccagcgagggcctgggccgcctggtggtgggcgacttctccgactacaacaacagctacgtcggggcctttgccgacgcccgctccgcctacttcgtgttccgccgccgcggggcccgggcccaggctgagtaccgctcctacgtggcccgcgtctgcctgggggacaccaacctgtactcctacgtggaggtccccctcgcctgccagggccagggcctcatccaggccgccttccttgccccgggcaccttgctaggggtgtttgccgcgggcccaaggggcacccaggcggcgctctgtgccttccccatggtggagctgggtgccagcatggagcaggcccggagactctgctacacggcgggcggccggggccccagcggcgcagaggaagccaccgtggagtacggcgtcacgtcgcgctgcgtcaccctgccccttgattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtctttctccacggctcccagggccaggtttaccactcccagcaagtggggcctccaggctcagccatcagcccagacctgctgctggacagcagtggcagtcacctctatgtcctgactgcccaccaggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccgtgtcgcgcttgcgtgggcagcatctggcggtgtcactggtgcccgcagagtagccactgcgtgtacggagagcactgcccagagggcgagaggaccatctacagcgcccaggaggtggacatccaggtgcgtggcccaggggcttgcccacaggtcgaaggcctggcaggtccccacctggtgcctgtgggctgggagagccatttggccctacgcgtgcggaaccttcaacatttccgaggcctgcctgcctccttccactgctggctggagctgcctggagaacttcggggactgccggccaccctggaggagacagcaggggattcaggcctcatccactgccaggcccaccagttttatccctccatgtcccagcgggagctcccagtgcccatctacgtcacccagggtgaagcccagaggctggacaacacccatgctctttatgtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggattgtgtgtgtgacatctcctgcccccaatggcaccactgggcccgtccgggtggccattaagagccagccaccaggcatctcaagccagcacttcacctaccaggaccctgtcctgctgagcctgagtcctcgctggggcccccaggcagggggcacccagctcaccatccgaggtcagcacctccagacaggtggcaacaccagtgccttcgtgggtggccaaccctgtcccatcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggcacaagagcaagcaggccctgcgggactaccagaaggtgctagtgcagctggagagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttatttta

SEQ ID NO: 166773 - DNA, 774 bp, Homo sapiens
  Payload ID: 12833
  Gene Symbol: PLXNB3
  Gene Name: plexin B3
  ENST ID: ENST00000411613
  CDS Start-End: 1-774
agagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacagagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctgg

SEQ ID NO: 166774 - DNA, 489 bp, Homo sapiens
  Payload ID: 12833
  Gene Symbol: PLXNB3
  Gene Name: plexin B3
  ENST ID: ENST00000455214
  CDS Start-End: 1-489
caaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagagtgagtccctcggccctgacctggggccactggagtccaggctgggcaggca

SEQ ID NO: 166775 - DNA, 526 bp, Homo sapiens
  Payload ID: 12833
  Gene Symbol: PLXNB3
  Gene Name: plexin B3
  ENST ID: ENST00000448847
  CDS Start-End: 1-526
ctgcctcgcagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggtgagagcagtgccagcagcagcagctggcaggggcttgaggaggaaaggcttatgggggaagcctagagggctgtgcacagagctctgggtgggcagtggcagcatcatgggggcaccttcacctccgagctcatgcctagcgcctcccctccctccggagcaggattccccagtgaacaaactgctctacgcccgggagatccc

SEQ ID NO: 166776 - DNA, 6377 bp, Homo sapiens
  Payload ID: 12833
  Gene Symbol: PLXNB3
  Gene Name: plexin B3
  Uniprot ID: Q9ULL4
  ENST ID: ENST00000538966
  CDS Start-End: 272-6070
gatgagtcggactgggcacgattgcattgtggggagggaggctggggctctgtgagacgtgctcctggcaccgccagctgctacttggccctcgccggtggcccaccaggacaatgcccccccgcagccatctcatgcccatcgccactgccctggggcagctgaactgagcgtatgtgccacgccgcccaggagacccctctgctgcaccacttcatgcacccccgctgccttgccccagtgcttcctcgccctggagctgggcgccagcatggagctcacccctgcctcttcgctgacttgctccttgctcagcccgcggctgcctggctctttcccccagctgcggagggttcctccttgcagccggccctggctgcccaaggcccccgtgatggctcgctggcctcccttcggcctctgcctcctcctgctgctgctgtccccaccgccactgcccttgacaggggcccatcgcttctccgcacctaataccactctcaaccacttggcactggcacctggccgaggcacactctatgtcggcgcagtgaaccgcctcttccagctcagccccgagctgcagctcgaggccgtggctgtcactggccctgtaatcgacagccctgactgcgtgcccttccgtgacccagccgagtgcccacaggcccagctcactgacaatgccaaccagctgctgctggtgagcagccgcgcccaggagctggtggcctgcgggcaggtgcggcagggcgtgtgtgagacacggcgccttggggatgtggccgaggtgctgtaccaggctgaggaccctggtgacgggcagtttgtggctgccaataccccgggagtggcaacggtggggctggtggtgcccttgcccggccgggacctcctgcttgtggccagaggcctggcgggcaagctgtcggcaggggtgccacccctggccatccgccagctggccgggtctcagcccttctccagcgagggcctgggccgcctggtggtgggcgacttctccgactacaacaacagctacgtcggggcctttgccgacgcccgctccgcctacttcgtgttccgccgccgcggggcccgggcccaggctgagtaccgctcctacgtggcccgcgtctgcctgggggacaccaacctgtactcctacgtggaggtccccctcgcctgccagggccagggcctcatccaggccgccttccttgccccgggcaccttgctaggggtgtttgccgcgggcccaaggggcacccaggcggcgctctgtgccttccccatggtggagctgggtgccagcatggagcaggcccggagactctgctacacggcgggcggccggggccccagcggcgcagaggaagccaccgtggagtacggcgtcacgtcgcgctgcgtcaccctgccccttgattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtctttctccacggctcccagggccaggtttaccactcccagcaagtggggcctccaggctcagccatcagcccagacctgctgctggacagcagtggcagtcacctctatgtcctgactgcccaccaggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccgtgtcgcgcttgcgtgggcagcatctggcggtgtcactggtgcccgcagagtagccactgcgtgtacggagagcactgcccagagggcgagaggaccatctacagcgcccaggaggtggacatccaggtgcgtggcccaggggcttgcccacaggtcgaaggcctggcaggtccccacctggtgcctgtgggctgggagagccatttggccctacgcgtgcggaaccttcaacatttccgaggcctgcctgcctccttccactgctggctggagctgcctggagaacttcggggactgccggccaccctggaggagacagcaggggattcaggcctcatccactgccaggcccaccagttttatccctccatgtcccagcgggagctcccagtgcccatctacgtcacccagggtgaagcccagaggctggacaacacccatgctctttatgtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggattgtgtgtgtgacatctcctgcccccaatggcaccactgggcccgtccgggtggccattaagagccagccaccaggcatctcaagccagcacttcacctaccaggaccctgtcctgctgagcctgagtcctcgctggggcccccaggcagggggcacccagctcaccatccgaggtcagcacctccagacaggtggcaacaccagtgccttcgtgggtggccaaccctgtcccatcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggcacaagagcaagcaggccctgcgggactaccagaaggtgctagtgcagctggagagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttattttg

SEQ ID NO: 166777 - DNA, 7346 bp, Homo sapiens
  Payload ID: 12834
  Gene Symbol: PLXNC1
  Gene Name: plexin C1
  Uniprot ID: O60486
  ENST ID: ENST00000258526
  CDS Start-End: 250-4956
gcgaggaggaaacggtgccggagcgcgcagggcttgctgccgccaccgccgctgcacaggctgccggagcgagcctgccgcgcgccgccctccccgctctccttcctgggcgagctgcggggatggggcggccgcgggagcccgagcgcgcgcaggaaccgccgccgccgccgcccgcgtctccgttgccgcgcgcctgagccgccgtcgccgccgcgcgccctgcccgggggcggcccccccagccccatggaggtctcccggaggaaggcgccgccgcgccccccgcgccccgcagcgccactgcccctgctcgcctatctgctggcactggcggctcccggccggggcgcggacgagcccgtgtggcggtcggagcaagccatcggagccatcgcggcgagccaggaggacggcgtgtttgtggcgagcggcagctgcctggaccagctggactacagcctggagcacagcctctcgcgcctgtaccgggaccaagcgggcaactgcacagagccggtctcgctggcgccccccgcgcggccccggcccgggagcagcttcagcaagctgctgctgccctaccgcgagggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcaaagaaggggatcaacctgaaagagtccaaccaatcgcatcatctaccttgatccattccgacctgacatccgtttatggcaccgtggtaatgaacaggactgttttattcttggggactggagatggccagttacttaaggttattcttggtgagaatttgacttcaaattgtccagaggttatctatgaaattaaagaagagacacctgttttctacaaactcgttcctgatcctgtgaagaatatctacatttatctaacagctgggaaagaggtgaggagaattcgtgttgcaaactgcaataaacataaatcctgttcggagtgtttaacagccacagaccctcactgcggttggtgccattcgctacaaaggtgcacttttcaaggagattgtgtacattcagagaacttagaaaactggctggatatttcgtctggagcaaaaaagtgccctaaaattcagataattcgaagcagtaaagaaaagactacagtgactatggtgggaagcttctctccaagacactcaaagtgcatggtgaagaatgtggactctagcagggagctctgccagaataaaagtcagcccaaccggacctgcacctgtagcatcccaaccagagcaacctacaaagatgtttcagttgtcaacgtgatgttctccttcggttcttggaatttatcagacagattcaactttaccaactgctcatcattaaaagaatgcccagcatgcgtagaaactggctgcgcgtggtgtaaaagtgcaagaaggtgtatccaccccttcacagcttgcgacccttctgattatgagagaaaccaggaacagtgtccagtggctgtcgagaagacatcaggaggaggaagacccaaggagaacaaggggaacagaaccaaccaggctttacaggtcttctacattaagtccattgagccacagaaagtatcgacattagggaaaagcaacgtgatagtaacgggagcaaactttacccgggcatcgaacatcacaatgatcctgaaaggaaccagtacctgtgataaggatgtgatacaggttagccatgtgctaaatgacacccacatgaaattctctcttccatcaagccggaaagaaatgaaggatgtgtgtatccagtttgatggtgggaactgctcttctgtgggatccttatcctacattgctctgccacattgttcccttatatttcctgctaccacctggatcagtggtggtcaaaatataaccatgatgggcagaaattttgatgtaattgacaacttaatcatttcacatgaattaaaaggaaacataaatgtctctgaatattgtgtggcgacttactgcgggtttttagcccccagtttaaagagttcaaaagtgcgcacgaatgtcactgtgaagctgagagtacaagacacctacttggattgtggaaccctgcagtatcgggaggaccccagattcacggggtatcgggtggaatccgaggtggacacagaactggaagtgaaaattcaaaaagaaaatgacaacttcaacatttccaaaaaagacattgaaattactctcttccatggggaaaatgggcaattaaattgcagttttgaaaatattactagaaatcaagatcttaccaccatcctttgcaaaattaaaggcatcaagactgcaagcaccattgccaactcttctaagaaagttcgggtcaagctgggaaacctggagctctacgtcgagcaggagtcagttccttccacatggtattttctgattgtgctccctgtcttgctagtgattgtcatttttgcggccgtgggggtgaccaggcacaaatcgaaggagctgagtcgcaaacagagtcaacaactagaattgctggaaagcgagctccggaaagagatacgtgacggctttgctgagctgcagatggataaattggatgtggttgatagttttggaactgttcccttccttgactacaaacattttgctctgagaactttcttccctgagtcaggtggcttcacccacatcttcactgaagatatgcataacagagacgccaacgacaagaatgaaagtctcacagctttggatgccctaatctgtaataaaagctttcttgttactgtcatccacacccttgaaaagcagaagaacttttctgtgaaggacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttgagcttcaaatgggcacacgacagaaagaacttctggacatcgacagttcctccgtgattcttgaagatggaatcaccaagctaaacaccattggccactatgagatatcaaatggatccactataaaagtctttaagaagatagcaaattttacttcagatgtggagtactcggatgaccactgccatttgattttaccagattcggaagcattccaagatgtgcaaggaaagagacatcgagggaagcacaagttcaaagtaaaagaaatgtatctgacaaagctgctgtcgaccaaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggaagcaccaactaataagcttctctatgccaaggatatcccaacctacaaagaagaagtaaaatcttattacaaagcaatcagggatttgcctccattgtcatcctcagaaatggaagaatttttaactcaggaatctaagaaacatgaaaatgaatttaatgaagaagtggccttgacagaaatttacaaatacatcgtaaaatattttgatgagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgcacctctgcattgtaaagggatactgccagtgctcaaaacaaaatgtgaaatgagtcatttggaaacaaggtgggggtgttagggcaacctcgaggatttgcagcattgaaactttccccagtagttcttggaaaagctgaccgcagaatttggtagtgtacacttagcatttgtgagtgtgtgtgtgtgtttaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacattttatcgaattgctgttcacactggagtattatatataaatatatatatttgaggcccaaggcctgaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctgaagacaatcagtcactgggtctatattaaacagcaaccagagcaacaaatggcaaacaatttctattttcaagtttctttgcatatttttttggtgcaaaaccatttataaacttttttttctaacactagtgtctacagcagcattcaaaaaaattctgttaccttttctgtattaggatttaaagtctatttcttattgtatacctgattgaagctgttcttggagatgaatgttttaaatgtctatatccaaaaaataaacattttgatgtaactgtg

SEQ ID NO: 166778 - DNA, 1813 bp, Homo sapiens
  Payload ID: 12834
  Gene Symbol: PLXNC1
  Gene Name: plexin C1
  ENST ID: ENST00000545312
  CDS Start-End: 577-1500
acagtgctgattcaagagcgtctcgagcactctgagtggtgagggggcggctcggctcgccaggaggaagtggcatccagccagtcggcgatactttcactttcagtggaataattcccgctggtgcaggggtctgatgtccctccaccaggtgctcaagggggtctgggacaccgacagccctagtcctcctgtcctaccccacagacgtttagtgggtgacagtagctccgtgaccgccaggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttgagcttcaaatgggcacacgacagaaagaacttctggacatcgacagttcctccgtgattcttgaagatggaatcaccaagctaaacaccattggccactatgagatatcaaatggatccactataaaagtctttaagaagatagcaaattttacttcagatgtggagtactcggatgaccactgccatttgattttaccagattcggaagcattccaagatgtgcaaggaaagagacatcgagggaagcacaagttcaaagtaaaagaaatgtatctgacaaagctgctgtcgaccaaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggaagcaccaactaataagcttctctatgccaaggatatcccaacctacaaagaagaagtaaaatcttattacaaagcaatcagggatttgcctccattgtcatcctcagaaatggaagaatttttaactcaggaatctaagaaacatgaaaatgaatttaatgaagaagtggccttgacagaaatttacaaatacatcgtaaaatattttgatgagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaa

SEQ ID NO: 166779 - DNA, 2455 bp, Homo sapiens
  Payload ID: 12834
  Gene Symbol: PLXNC1
  Gene Name: plexin C1
  ENST ID: ENST00000547057
  CDS Start-End: 238-2085
acttgtaaaatgagtaaggttttggtttttttctgctgcattttggcatcttcctcttcagagtgacccctcactgggaaattttcttataagatccagctttttaatgctattttctagtttcattctagctcctgctctctgtccctatctgttttgtttttgtttttgtttttaagaactgtaaagattgctatttgttttcatttttggtttttgagttaccatgtccctctgatgcagcatctctgtctcttagcggccgtgggggtgaccaggcacaaatcgaaggagctgagtcgcaaacagagtcaacaactagaattgctggaaagcgagctccggaaagagatacgtgacggctttgctgagctgcagatggataaattggatgtggttgatagttttggaactgttcccttccttgactacaaacattttgctctgagaactttcttccctgagtcaggtggcttcacccacatcttcactgaagatatgcataacagagacgccaacgacaagaatgaaagtctcacagctttggatgccctaatctgtaataaaagctttcttgttactgtcatccacacccttgaaaagcagaagaacttttctgtgaaggacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttgagcttcaaatgggcacacgacagaaagaacttctggacatcgacagttcctccgtgattcttgaagatggaatcaccaagctaaacaccattggccactatgagatatcaaatggatccactataaaagtctttaagaagatagcaaattttacttcagatgtggagtactcggatgaccactgccatttgattttaccagattcggaagcattccaagatgtgcaaggaaagagacatcgagggaagcacaagttcaaagtaaaagaaatgtatctgacaaagctgctgtcgaccaaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggaagcaccaactaataagcttctctatgccaaggatatcccaacctacaaagaagaagtaaaatcttattacaaagcaatcagggatttgcctccattgtcatcctcagaaatggaagaatttttaactcaggaatctaagaaacatgaaaatgaatttaatgaagaagtggccttgacagaaatttacaaatacatcgtaaaatattttgatgagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgca

SEQ ID NO: 166780 - DNA, 1894 bp, Homo sapiens
  Payload ID: 12834
  Gene Symbol: PLXNC1
  Gene Name: plexin C1
  ENST ID: ENST00000549217
  CDS Start-End: 60-1310
agccaactgggatctttggttacaagtgaaggttatttgatttagctttcacttgtaaaatgacggccgtgggggtgaccaggcacaaatcgaaggagctgagtcgcaaacagagtcaacaactagaattgctggaaagcgagctccggaaagagatacgtgacggctttgctgagctgcagatggataaattggatgtggttgatagttttggaactgttcccttccttgactacaaacattttgctctgagaactttcttccctgagtcaggtggcttcacccacatcttcactgaagatatgcataacagagacgccaacgacaagaatgaaagtctcacagctttggatgccctaatctgtaataaaagctttcttgttactgtcatccacacccttgaaaagcagaagaacttttctgtgaaggacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttgagcttcaaatgggcacacgacagaaagaacttctggacatcgacagttcctccgtgattcttgaagatggaatcaccaagctaaacaccattggccactatgagatatcaaatggatccactataaaagtctttaagaagatagcaaattttacttcagatgtggagtactcggatgaccactgccatttgattttaccagattcggaagcattccaagatgtgcaaggaaagagacatcgagggaagcacaagttcaaagtaaaagaaatgtatctgacaaagctgctgtcgaccaagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggaagcaccaactaataagcttctctatgccaaggatatcccaacctacaaagaagaagtaaaatcttattacaaagcaatcagggatttgcctccattgtcatcctcagaaatggaagaatttttaactcaggaatctaagaaacatgaaaatgaatttaatgaagaagtggccttgacagaaatttacaaatacatcgtaaaatattttgatgaggtaagattttaaataacattgtttttaacctttgaatcaggcacaaggatgtggttatagcattctgtcagtttcagaacagctctggcatcccaaaaggccagaaagggaagccaggaagcctgtctgagatgggggatcctggcactgagccagaccctgtacatggctgccccccttacagttttatcatgctgcccacatttggaccagcctgaatttacatttgagttcatggggcctacagccaccctgactcaagttaactttgatg

SEQ ID NO: 166781 - DNA, 557 bp, Homo sapiens
  Payload ID: 12834
  Gene Symbol: PLXNC1
  Gene Name: plexin C1
  ENST ID: ENST00000550080
  CDS Start-End: 248-557
tttagctttcacttgtaaaatgagtaaggttttggtttttttctgctgcattttggcatcttcctcttcagagtgacccctcactgggaaattttcttataagatccagctttttaatgctattttctagtttcattctagctcctgctctctgtccctatctgttttgtttttgtttttgtttttaagaactgtaaagattgctatttgttttcatttttggtttttgagttaccatgtccctctgatgcagcatctctgtctcttagcggccgtgggggtgaccaggcacaaatcgaaggagctgagtcgcaaacagagtcaacaactagaattgctggaaagcgagctccggaaagagatacgtgacggctttgctgagctgcagatggataaattggatgtggttgatagttttggaactgttcccttccttgactacaaacattttgctctgagaactttcttccctgagaacagagacgccaacgacaagaatgaaagtctcacagctttggatgccctaatctgtaataaaagctttcttgttactgtca

SEQ ID NO: 166782 - DNA, 527 bp, Homo sapiens
  Payload ID: 12834
  Gene Symbol: PLXNC1
  Gene Name: plexin C1
  ENST ID: ENST00000551850
  CDS Start-End: 201-527
cccatacagtctgatgctcatggcaagagagacgtgaccaaaagctgccgtggaagtcccaaaaagaggcactactctcagcctgggaggatctgggaggcttcagagagaaagaaggggatcaacctgaaagagtccaaccaatcgcatcatctaccttgatccattccgacctgacatccgtttatggcaccgtggtaatgaacaggactgttttattcttggggactggagatggccagttacttaaggttattcttggtgagaatttgacttcaaattgtccagaggttatctatgaaattaaagaagagacacctgttttctacaaactcgttcctgatcctgtgaagaatatctacatttatctaacagctgggaaagaggtgaggagaattcgtgttgcaaactgcaataaacataaatcctgttcggagtgtttaacagccacagaccctcactgcggttggtgccattcgctacaaaggtgcacttttcaaggagattgtgtacattcagagaactta

SEQ ID NO: 166783 - DNA, 7094 bp, Homo sapiens
  Payload ID: 12835
  Gene Symbol: PLXND1
  Gene Name: plexin D1
  Uniprot ID: Q9Y4D7
  ENST ID: ENST00000324093
  CDS Start-End: 180-5957
ccgggctgcgcggcgaggctgacccgggcccgggcgccggggtcgggggcggctggcgcgggcaggaagcgcatcgcggcccgggcccgccccccgcctcccgccgcctccgggctcccggctcccggccgcgcctcgccccatgcactcgccgcgccgcgcagcccgcgcacgcccggatggctcctcgcgccgcgggcggcgcaccccttagcgcccgggccgccgccgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgtgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcggtgcaccttgcagcaggactgcaccaattccagccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctacgggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcatgtggagtgatggctgccgcctgcgggggcctctgcagcccatggctggcacctgccccgcccccgagatccacgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccactctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcagtgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctactgtgggctccagcctttgtcctgagatagccaagcggg

SEQ ID NO: 166784 - DNA, 477 bp, Homo sapiens
  Payload ID: 12835
  Gene Symbol: PLXND1
  Gene Name: plexin D1
  ENST ID: ENST00000505665
  CDS Start-End: 1-338
ggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcggtgcaccttgcagcaggactgcaccaattccagccagcagcatttctggaccagtgccagcgagggccccagccgctgtcctgccatgaccgtcctgccttccgagatcgatgtgcgccaggagtacccaaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctg

SEQ ID NO: 166785 - DNA, 546 bp, Homo sapiens
  Payload ID: 12835
  Gene Symbol: PLXND1
  Gene Name: plexin D1
  ENST ID: ENST00000504689
  CDS Start-End: 88-255
gattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaaccta

SEQ ID NO: 166786 - DNA, 507 bp, Homo sapiens
  Payload ID: 12835
  Gene Symbol: PLXND1
  Gene Name: plexin D1
  ENST ID: ENST00000505237
  CDS Start-End: 1-507
ctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcgccagcagcatttctggaccagtgccagcgagggccccagccgctgtcctgccatgaccgtcctgccttccgagatcgatgtgcgccaggagtaccca

SEQ ID NO: 166787 - DNA, 2662 bp, Homo sapiens
  Payload ID: 12835
  Gene Symbol: PLXND1
  Gene Name: plexin D1
  ENST ID: ENST00000512744
  CDS Start-End: 1-1141
ggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcagtgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacaggtggcggccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaa

SEQ ID NO: 166788 - DNA, 691 bp, Homo sapiens
  Payload ID: 12835
  Gene Symbol: PLXND1
  Gene Name: plexin D1
  ENST ID: ENST00000506979
  CDS Start-End: 1-691
gtccctccatcccgggtcactgttgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcag

SEQ ID NO: 166789 - DNA, 6252 bp, Homo sapiens
  Payload ID: 12836
  Gene Symbol: PLXDC1
  Gene Name: plexin domain containing 1
  Uniprot ID: Q8IUK5
  ENST ID: ENST00000315392
  CDS Start-End: 213-1715
agctccccgcctgctcccggaggccgcagcctccagctccgctcgcgctctcgccgctcctgccggctcgcccggccccgcgctccgccgtctcctcgccgcccgcccctccgccagccccggggaccgcgcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaactccttgtctctcaacgtattggctatgacgcagcaagcagaatgaatttggactcagttacaggctgtcaatggtctgctctgtagcagtctcagagcctccccgacccactacctggagatagccagatagccagatgccctgctcctggccacctttaaagcccctgcatatgacacaggttaactaaagtcaagattggggctgctgcattccaggttccctagactcacaagctggtccttggccaggtgcagtggctcacgcctgtaatcccagcactttgggaggctgaggcaggcggatcacctgaagtcagaagtttgagaccagcctggccaacataattaaaatgtctctactaaaaatacaaaaaattagctgggtgtggtgacgcttgcctgtatcccagctactcaggaagctgagacacgagaatcacttgaacctgggaggcagaggttgcagtgagctcagatagtgccactgcactccagcctgggtgacagagcgagactccgtctcaaaaaaaaaaaaagaaagcagatcctcatggctatagagttggcattttagccccagcttctgtagctctgaaagcctaaagaaggtattctctccatctgttaaacacagtatagtggctctcagcccttggggcatgttatcatgggagggaagtcaaataagaggagagaaaagaactcaagggggaaactgcatttttaggctttgctctcttaccttgccctttctactcagaaccaataacttctgcatcaaaacatgttacagcctgcatcaagggctttaccccaacctgcagcccagccttccctgggtgagcttgctatgcgcagccacatttaccatgtggggctccctattctgatggcctgttcggtgccgggtttactcactgccctgttctgatgtcagtgcctgtacatacctccaaaggcaggacttgcctgataaatatttttcctcctctgaactggattttataggcattaaagacaagtcgggtggctagagggctccttgagacatacctagcagggaactgcaggtggattctgttgagaggcaaagcacctgagtggttgggacacaggcagctggcatgggagggactttttttgagacagggtctcactgtgtcgcccagggcaaggatgcccaaagacaccaggttggagaggcacctgccaactacttgctttccctggagcctgcatgtgcctgtggggtggggaggcgtaggggtctacggctgcctgagatgggtgtgcacagtgtgtgaagtacctacctccttgccttgctggactgtcagccagtcgcagggccggccacaagacccatgtctccatctggtcatactccatagctaccaagttaacctgctctaaactttggagaactggatctgtccaataaacgcttatttggccaagcctgatggctcgtgcctgtactcccagcactttgggaggctgaggtgggagggttgcttgagcccaggggtttgagaccagcttgggcaacaacaacaaaaatgccaggtgtggtggggtgcacctgtagtcccagctactagggaggctgagccaggaggatcacttgagcccgggaggttgaggctgcagtggggggtcataatcatgccactgtactccagcctgggtgacagagtgagaccctgtctccgaaaaaaaaaaaaaaaaaaagaacggaaaaagaaatgcttacattgtcagggatcctgtagacaatcattaactctatgagatgcttggttctatttttttgggagactttgtccaagtgttttggcttaagaaatccataggcctctcttggtgacacatctctagtactttttgtcataaacaaacaggccatctgccgccaaatacatccactccccatgccactgacatcctatgggtcagccaggcttgctttgactgaggccgaggcatctggaactttctctgcctgcaggggctagcagcagaggcttcaccgcatcaccaccccttcctccactcctgacattctttcccttcagggatccaaaatggttggccgagctcccagtgggaaaacgtgtgctagagttggggagtgagatgagtggtgctgtccatggaatcaggccacagcaggaactgccccactggccatttgagacacacacaggtggtaaatgctctgctggtgggctgtgcttccctcattcagagagctctgttacagcccactgtgtcctttagaagcttgaaaggaacccaactctttgctgcactgtcctttttcttcctcaaattcagaccctccttccaccggcacccccctactccaccctcagctcttccttgcctggtttatcaagcagagctgaggccccacgtttccaactctgattgtcacttgcatcttcacaaaggataaaccacggagcaactggaaaaccatcagccaagcgttcggatgagtctggttattggtccacccccgaccagattcccttacacttaactcacttctttctttggcaatgaccctcatgacatgtataaatgggtatgactaagaagaggctgtgatctaacatttatttgctgccattttttactctggggagaagcagccccaactcatcactgggaaagaactccccctgcaaaccagctaaatttgataatttaaaccccctgcccctaaaacttctcacagagctggggagttggtggcaactttccaagtcaaggtcttgcttagaaagtccttcactacatggccaggtgcagtggctcacgcctgtagtcccaggtacttgggagcctgaggcaggaggattgcttgagctcaggagttcaaggctgcagagagctatgatcatcccactgcatttgtttaaaaataaatttttaaaatttgtgtgttttatcaggggtctcctgtacagtgtatctgtgtatgtttgtgtgtgtgtttgtatacagccttgtttaatgttttgagcaataagatatgcacacacaggtattttgttgctaaagagattggacaaggttgtagctgtgctcaggcttcagcttggtttgttaaattgagagataaacaatgacaagagctgccagccaaccacactattcaaaaagcaaagtgttcaccactaaagctaaccattcatctggttgcaggcaaggctaaggctctctctcctctagttcctggaacagactcacagattggcatgaagcactgatcaggggctgcactcagactccctggccaagcaaacctacaccagaagagtcagtgtcacagatatgatgcggccaatctctgtctccaaaaacctacctgaacttaatggtagaattcaaagatctggggactgagggcacccagccttctaaaacacaatgtattcatgtgtttagtgtaaactctctgcatggattctcagtgttaataataaaaggaagcattcttttacaactcctgctgtgtgcaaaagaaagtgcaaaggatttggagtggcattccgaagatcaccacacataccttggttctgatggctgctgaactccgacttcttcgctgagacatgactgtgggaacagcctccagctatctgctcatcagaggtgctttcctcaacctcctgcaccacctccaagagaaacagcctaaaaagaaaccccagctgtttacttatattggtctgtaaatccctggaagtaaaccccatgcatttttatctactgtctgaggacatacaataaatctgagaaagtctatgctgtca

SEQ ID NO: 166790 - DNA, 876 bp, Homo sapiens
  Payload ID: 12836
  Gene Symbol: PLXDC1
  Gene Name: plexin domain containing 1
  ENST ID: ENST00000441877
  CDS Start-End: 211-876
ccaggatgccccctcaccccgtctcccactctccagcgccccagctccttgccgtcacaagaacgaagtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggcc

SEQ ID NO: 166791 - DNA, 2082 bp, Homo sapiens
  Payload ID: 12836
  Gene Symbol: PLXDC1
  Gene Name: plexin domain containing 1
  ENST ID: ENST00000444911
  CDS Start-End: 20-1402
ctcctggaaaatttctccaatggcgctcagcgttcgcacccttcctctccgcggttttctagtccctaggccccagcccactagaagccaggatgccccctcaccccgtctcccactctccagcgccccagctccttgccgtcacaagaacgaagaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctc

SEQ ID NO: 166792 - DNA, 619 bp, Homo sapiens
  Payload ID: 12836
  Gene Symbol: PLXDC1
  Gene Name: plexin domain containing 1
  ENST ID: ENST00000415163
  CDS Start-End: 247-619
cagctccttgccgtcacaagaacgaagtaggtcaggggagggaagaggcatcttcgtgtcctgacctgattccttgccgtctattaaatatcctacattgcgggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatg

SEQ ID NO: 166793 - DNA, 2859 bp, Homo sapiens
  Payload ID: 12836
  Gene Symbol: PLXDC1
  Gene Name: plexin domain containing 1
  Uniprot ID: Q8IUK5
  ENST ID: ENST00000578390
  CDS Start-End: 83-1096
gcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagtagagatgaggtttcaccgtgttagccaggacagtctcgatctcctgacctcatgatccgcccgcctcggcctcccaaagtactgggattacaggcgtgagccaccacgcccagccgcaagaagcatttttacaaagcattcagcatccttcgcatgagactcacagagcctcagaaagaatatgtaggatagaccccaggtccctcaacaaccaggatgaaaacacgtatgtgaattgcctggattctcagcagtgtcacggcagctcagagtcaaggcgaccttgaggatcactggagctcatgcagtcctgctagcccctacacctactcacatgggcagatgtggccttggtcctggggagctgggtgggaaggaaggcagggatgccacaaataccttcatcttccggggaagtagagggaatgggagtgcctgactacctcagcctggggaccttggctcctcttctcactatcagcagagagctgttactgaacagtgaaaggggaaggcttctttgtcaatcccatcataactctgtccttttggtcctcctgcagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaa

SEQ ID NO: 166794 - DNA, 1039 bp, Homo sapiens
  Payload ID: 12836
  Gene Symbol: PLXDC1
  Gene Name: plexin domain containing 1
  ENST ID: ENST00000578808
  CDS Start-End: 253-552
gctgcagctggaggtagctgcctatctgattctgtttgagagtccgccaagttgggatttaaattagacatcaagaagaatttacagaccggccttgccttgttccacggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggtgtgggaagggaccggcagcactggcagtgcctgggagctcgtgggaaatgtggaatgtcggagtcctcagacctgcagaatcagaatccgattcccaggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccg

SEQ ID NO: 166795 - DNA, 565 bp, Homo sapiens
  Payload ID: 12836
  Gene Symbol: PLXDC1
  Gene Name: plexin domain containing 1
  ENST ID: ENST00000579190
  CDS Start-End: 272-565
ctttttgctttcgcaggcgagtgaggatggagtcctggcccctgccagtggctcagcctgtgtgtgtacccagggtagaatgcaatgcgagtgagggcgaggagctccgggctgacccttggaacacggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagct

SEQ ID NO: 166796 - DNA, 547 bp, Homo sapiens
  Payload ID: 12836
  Gene Symbol: PLXDC1
  Gene Name: plexin domain containing 1
  ENST ID: ENST00000579279
  CDS Start-End: 1-547
caaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagaggtccctcaacaaccaggatgaaaacacatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacct

SEQ ID NO: 166797 - DNA, 2822 bp, Homo sapiens
  Payload ID: 12837
  Gene Symbol: PLXDC2
  Gene Name: plexin domain containing 2
  Uniprot ID: Q6UX71
  ENST ID: ENST00000377242
  CDS Start-End: 842-2284
ggcgacggcagcgcctcctccgccaccaaactcctggggctccgcgggggcttggggccacctcctcctgagcccggaggaaccctctcccgataggttccagcgtgactccctcccactccacccttttcctttcttcttcctcttttttttttttttttttaaacacatttttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgtgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgagagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccgtaggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcattggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgagggatcgacacctttggttcaaatgttctctgatgtctcaaagataactgttttccaaagcctgaaccctttcactcaaaagagcaatgatgaatgtctcaagattgctaagaaaaacagcccatgcaagagtgagaacaaacacaaaataagagattttctacattttcaaaa

SEQ ID NO: 166798 - DNA, 12468 bp, Homo sapiens
  Payload ID: 12837
  Gene Symbol: PLXDC2
  Gene Name: plexin domain containing 2
  Uniprot ID: Q6UX71
  ENST ID: ENST00000377252
  CDS Start-End: 842-2431
ggcgacggcagcgcctcctccgccaccaaactcctggggctccgcgggggcttggggccacctcctcctgagcccggaggaaccctctcccgataggttccagcgtgactccctcccactccacccttttcctttcttcttcctcttttttttttttttttttaaacacatttttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgtgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgaggaggatacagaccacaattactatatatctcgaatatatggtccatctgattctgccagccgggatttatgggtgaacatagaccaaatggaaaaagataaagtgaagattcatggaatattgtccaatactcatcggcaagctgcaagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccgtaggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcattggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgagggatcgacacctttggttcaaatgttctctgatgtctcaaagataactgttttccaaagcctgaaccctttcactcaaaagagcaatgatgaatgtctcaagattgctaagaaaaacagcccatgcaagagtgagaacaaacacaaaataagagattttctacattttcaaaacagatgtgtggcaaaaggatgttgtttttctggtctagatccatctgtaccaacaagttcatcactttacagaacgaatctttttatccgtacaggaggttcaaaccatgtctgcctcttcctttgtaatgaatgacctttctatgagctgtgacaaaatttccgaacaattaactaaggatttgggaagagggggtggcaaacggggctttctgttttcctgcctcagcatgaaaacatctgatttatgctttatggaagccttacctccaatccccaactgttaagtcccatgaaaccacagttgctctgggctgatggaaacaaaaggaaacagtatgaagagttccttaatcatttttgaaacaaaaatgttaagggattttaaacatatgattatttttaattttatgccttttcagtactaaacacccatttcattgctgattcctgtctaagaagccattcacgtcagcatggcgatagaaagaatgaaaaaaccctgctgaatcatacagtaattttctttaaagcacatagtagttacataaatatatatatataaatatatttttgtttataactaacacaaggcaggatcttgtgactctaagagtgcgttttgtcatcaaggcaaaacagatgcaagatgcatcactgcattacttccatagagttgtaaaataatccttaatattagaatatttttctgtcacttagcaaaagtggttcagttcattgccgcgcccatcatgttcttgactatttgatccactttttcgtttatgtcaaccccttccctctctggctaaataaagtggatgcagaaagctccttaaatggagatatcgattgccttggaatcacaatcctgattttgaaaattcctcatgaatgaagaaaggaatggcatcccttgagaaggaaagtggttaatatacatactgagctcctaaagtttaaattcaggtactgagtgtacaatttcaccaacattctaacccatgaaacttttacactctgtgccaagaaactgttggcttttgtaaggtacagtgctcaacatttgcagattcaggtctcaagaagcagagatgtctcataagcagcattttcccaacagtttagcatctgtacacatctgccttggtcatcagtccactcacagagtaccatactttatcatcacaagtgtctgacgtgaacgaatgccattttctattccatatattttgctttacaattttaagtatttgatgaagatggtaactttttcctaacttagttaactattaaaaaaaattttgaaaagcaaggtgattgaaggattgtgatgacaatctctttgcagcagctatgtatggtttatgtgaagtatccccacttattcttgtggagcaggtttggtgagacagcaataaccaaatgacatgccaatattactggtgcaactggtattctacaaatgcataaggaacacatagacgacttccttttaggataaaatgatgcttctttcactaccttttgtggtagctgtggcttccaatagcaactgtttgacagttatataaatcttgcatgtgtattcttagtttgtgtcccttaagtactacttaattctcaagtagtaatgttattcttatacccttcagcgttctattttgattcaaaacaattgattcaaaacaattttgaatcaattttctattttgattcaaaacaattgataattctgtaaaaaaacataaacactgaattcttcagtgaaccaaagcaacaaataatagagaaaacttcttgaaactggagtgtgggaaaacttcttaacagaactaagagttaaaggtagtgagaagtgtgtggtgtgtgaattctttagtggtaaggggaaatgtgggctaaatccttttctttcatgaaactctcattctattttatatttctggtttgttcttgttcccatgtgagaaaacatacagtttctgaaaattcaaaatggtcatcaatgctttggactttacataattatgtattagagaaggtgcaactgtacattacttaatatactatgaacataatagaataacaaaaaaagataacaaagagatgcaaacttctggataaatcagataaatggtgctacagaggaatttagttatttcagcttaattatttgtaaaaataataatcagtgactaggtaaagatactgaaactcaagaaaaatatcttgacccatttatgtctagtgttccattattggaacgctaagcttatgggagttatttagagcctactgctcaaggtcatcaccaaggtctggttgcaaaaattcaaaaaattgcaacctcaggcataaatggcttaagcccaagagatggcactgaccataaatggtggcttgtgtgtgaagggtttggacttcaagatatactaacacctagaaaactaaaagtgcaattgacccccaattactattttagtttgaggtatcaagggcatttgccaatctcttatatgtagcttctagagttgtgctgtccaatattatatccactagccaacgtggcttttgaaattaaaattaattaaaattaaattaaaaatgtaattcttcagtcacaccagccacatttcaaaggctcaatagccacgcctggcttgtggctaccatattggataacaagaaacacttccgtggttgaagaaaattttaatggacaatgctgtgtttcatttgaattcgttgtccttgaagaaaagggaagaagaggaaagaaacaagatttggtagctcttgggcatatccaagcatttttgattttagagaggccctatggagtaatgaaaaaaatacaagctgacacagctttaaatccccactgtgttatcttgggaaaatcacttcaacctccttgagtctcaatttgcaattttggaaaagaaaaacaatttttgtcctgtctttcttgcaagattattatgcaacctgattaaatgtacagatgtgcagactcttaaaaaccttatgttaatgtaacccatataaagtacgacttttggtcgagtaccagcacaaatttgcattcaaaggaagaatagttcatcagtgcaaaaagcgttcaaaggtaatcagttcatcacgtatcttgagaaaaagagaatgcattcaaaacacaaagcaaaattgcttcagtttcttttctgcccatctgaatatttcctttagtatttgtcccacatgacatccatcccatgtatttatccactctttcacaacattgcctatgaacatccttcaactggctcagttctttattgcatagagccacttagcttctctagtttcttatgatttcctattttacacttaacagcaaaaggaggcttccatttagaaggcactatctcaaacataaataatttcatatttattttatcactgtaacactaaggagctatggcattaaaatataaaactatttggaacttaatgtaaacctttgcacatgcagactatataaagggaataaaattattttaaattatgctaatatccagatacatattctaaggttagtatcatttatcagtttttcgcaacagattcttatgttacatcttcatgagggagtataaatttgatcacgtccctagtgtctattgcccacttgagaaaggttttgccaggatccacagatcgcttcaagatgctttcgtttatgataggaaattaatatttaaataagactaattgaaaactagattatctggttctaatttcttcctcctgtgaaatgttcttttggtttgtatttctttaggtattttccaagttactgctgcttttacttcacgacctccaaccccacttttgttatcagcgtcatatgccagagtcatggcagatccagcctggacaacatagtgagacccatctctatcaaatatacatatatatatatatatatacacacacacacacacacacacaaatatacatatatatcaaatatatatgtatatttgatagagatgatagcaattatgtgtgtgtgtgtgtgtgtgtgtgtgtgtgtgttagccaagtgtggtttctcatgcctgtagtcccagctactttggaggctgaagtgtaagagttgcttgagcccatgagttagaggctgctgtgagctatgatcatgccactgcactccagcctgggcaacagagcaaaaccccatctctaaataaaaaaaaagaatcgtgagacatcatgtaatccaacctcttaatgttacagataagtaaactgaggcccaaagagatatagtaatagtcccagtgtcagtaaactgggtcttgaacttaaatgtttgtttcagttctcattgccttcatctcttaattgtcggcacttaaggccaaccaagcagcttagacagcgcagtccactcaacggtaactttatttgctatattgacaatctgctctgttctgtaatatagaacattggatcaatctttatctttttgctgacttaaggaggctgctattgttgcaatatccagagatttcaagttctagccattgcggggtctttgtggtgttttcaatttctcctctctccacccctgcccccatctgtggccatctaagttagcaatacaatttattttggccatttaaaatttttctgcctttgttttatttcttcccaaatatatttgaaaatgaatgatctatatagctgattttctgaccacatatataattgcaatttttatttgctcttcaaactattacaacatttttgtccttataaggttttttgggcagataatgcgaggtctgtggtgttaccttttatatactcctattaccttatgtttgtgaagcattttacattttacagagcactttgattcatctccctatttgttcatttatttaactgttcagttcactgaaatatttattgaacacctactggaaccaagtgactgtgctagtaacttgtgatatacagtagtgagagtccaggcatgtaaccgatcattataatacaataacatccctaaaccagactttacaagtagataggatcaacaatactctatcaattttcaactccaattttctattctacttaaaatgggaactagaaactgtttgcctgaagaatgtgtctgaaacataatatatcactgcatgtctgtgctgtagacctgttaattttatctgtgagaaaaaaagttactcaaaattctccctgacctaagaatactttctagttcactgcagtcttactgaccagatgcaacagttgaagtttgatttctcgacccaatatttctattgggttttgaattattaatatcactgttttgaggtattcagaaacaccagtgtatcaaaaaagcatttgcactttaggtgtgtgtggtggttatgtcatttattagaccatcccagacataagacaatcagggaaatcagaaaactccagcctcaaatgtgtctataatttcctgttctaccattgtcatatcataacatggtattacttcttaaggttttgattaagttgatctagcctcaacttaaattgtaatacatctgcctaattattgtctggaataacttttcaaccatccaatgcccactgctctcacaatgattattgtagagaagtaaaatggtaattattcaagtaaagtcacataatttctggagtcagtttttcataacaagtttatggaatacatcatcattggcttcttcataatatatttattatgagtgaccaaattttgcctggaggagcaaaatgctcaaaacttgttattataggttaatttccagctcactgttgacactgaaagattctgtgttactttaaacccaggataaaaggctggaaaaaaaattaaatgtaagtcataaactagtactcagcttttcctagtttctaaggcttattaacatttgcaaattactcaataaatgtctttcataatggaataacataaaagcttttgatttggcagatagtgatattttatttattttcattctggttgaaaaaaatctcagtggcttctcttcattccacgagaattttgatttttaacagcagtctctctttttctcagcattgcaaatatatatgtatatatacattcatgaccaaagtatcgcttactgaccatgcagctgtaaaccttctgtgcctatcaaacaaatacatagcatgaaactaattttagaagtttcatgggggaattttaggggaaagtataaacctaagagtgagtgaatggagatgattcatggaaaaaaaaataaaaatctaaatgtgctattaggcagagttattaacttcttttagttgttgtttgagatggggttttgctcttgttacccaggctggagtgcaatggcgtgatctcgtctcactgcaacctccgcctcccaggttcaagcgattctcctgcctcagccgcccaagtagctgggattacaggcatatgccactacagccggctaattttgtatttttagtagagacggggtttctccatgctggtcaggctggtccccagctcccgacctcaggtgatccgcccacctccgcctcccaaagtgctggaattacaggcctgagccaccgtgcctggccgagttattaacttcttaagagcaatgtgctaataaatactcattgatgaccagctcaaatttaggtcattcagacatccagacactggggcacatattctgcaagcaatgctgagacccctgacatagagaaagcaaaggatatgcctatgattagtctaaaatgcagccatcaccccccatacctcttctatggcattcatcctaacatcatggaggcctttgtcctagagaattatgtgacttgccctagagaattagtgaatgaccaaaaagagactttccatttatcttcctttgacttaaaaggcatgaaaataaggcaaaaaaatcaataaaataattttcctgaggaaaggttaagagatggcactttcctttccgggcccagagctggatttctctgagatttgaccatctcaggactcagacagactccagtgctattttctggacatttgtggtgaagcctcagccaccatgttcaaggtggtttgaatgaaaacatactcagattgtcacatttatagcagggaaataaaaactcaaattaggcatcctgcagcaggctactctgaaaataacattaggcaacatcagagcttcacttgcaaagaaatgttaaaatcattttagggaaatcagtgaagtctctttagaaacagacatcttgtgtatggcgtaacccagtcttggggccctcacggagaagagggggaagtcttttcattgattggtcaaaacaaatctctcatttgcctgatttgaagcatttcaacagtgcctggagagtacattattttcaggggaaaaaaaggagagagtcttttttatatgccagctgggatcatgggaacttcgaatgccaggaatttactactgtttctggtaattctgtgtgtagtcatttgaaatgttgaagtgtgaaaagagaagaaattgggcacttcttgcggcgggggagggggggggggcggtggctttccagattttatgccagttgcaccagcatgcagaatatttgtaatgcatttcaaagtggatataatggcaccctttgtcagaatcacaaagctcactgcggcactgctacaagaggacactgaggaaaatctggccctatgaacctagtcaaccccaagcaaaaagaatgactatgtgtgtgagtgcagcacatggccagttcgtttctcactgttttggaaagccctgtgtgccaaaccaaggacgtgtctttcagggaaaggttaattttccgaagtttattaaaatagaacttggaaaaccaagcattttgaatttattccagtcctctgggcatcattcctatttcttctgccatgtcaaggagaaattccaagcctgcattctgtcatgctaaaataaccagcccatacttctcggtgaccttctgttgaacgtacctgagcctgcaaatgtaaaaatgattgtatctgaatctgcactaatggtgtctgagagcaaaaagagtgtgacctctattggaaacctttgttcaaattcaataattcagagatgctacatacttctgcaagcttcctgattatgttcactgtaatattaatgacctaagtttgaatgtatttccttacagtccattaatttgacatccatcttttacctggggattattacaattgcaataagtcattaatgttttcttcacacagcttcttaaaccaagtttctctgcagctctttcggttctgcttacagtgtgtgggaaatctgatttttttcccctagtaatagtttgataagaaatttagtgtattgactgcctcagtgacacaatttatctttaaaggtgtggaagctggtggggaccaaatgttacctgtgtttttgctgttgattgctattttcagaagcaaaccatgtttttcacttacagtaggagtcaacaaatttgggattttagaagggggaggagggagctatttgtgtaagactgctgtcatatttgactacatattaaaaacagtaaatgagcattttgttttaatttcttaaataccttgtctttcaacatacgttttgtttcctttcttccattagtgttcaaaaggttctacccattgtggaagaaattctgtgtgcagaattcagaggcacaaggctgatggcaagatagaaagttattttgcttctaaacccaccccgatgtggaaactgatactagctagagggagctgtagaaaacaaagatttcaggattgcacagtgtgtgggcaatgggatggagactttttcccctattcccagccacagtgcccaagcgttcaagtctcctggatcagacagatgggattttagctgctgctttaaatcctagtgctggaataagtcaaggtacttcagttcagctcttgcctctgtcactaatcttgctttatgaactcctttgattttctgaataagttccagaaggttctctattattctgtccttcttccaaactggaaatggctgtatctaattctcaggatattttggatgtgtgcctcaggtaatttatgtggaatgtgtaaagcaagatgtctccaattctgaatattccttccccttttcccaatcctccactcttggactacctttataacaacaccgagtacgcacagacctgaacccatgcccaagaagcacacacaatgactggagctgtcgggaattcctgtcagtggcattccctgagcactggctctgtacaactcaattataattttttaagaatcatacctctgtatagatcttttggactgtactgattaaactttgatattgtggagtaaattcagaagtgcaattttaaa

SEQ ID NO: 166799 - DNA, 773 bp, Homo sapiens
  Payload ID: 12838
  Gene Symbol: PMF1-BGLAP
  Gene Name: PMF1-BGLAP readthrough
  ENST ID: ENST00000320139
  CDS Start-End: 8-535
cttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctagggtgtcgctctgctggcctggccggcaaccccagttctgctcctctccaggcacccttctttcctcttccccttgcccttgccctgacctcccagccctatggatgtggggtccccatcatcccagctgctcccaaataaactccagaagaggaatctg

SEQ ID NO: 166800 - DNA, 852 bp, Homo sapiens
  Payload ID: 12838
  Gene Symbol: PMF1-BGLAP
  Gene Name: PMF1-BGLAP readthrough
  ENST ID: ENST00000368276
  CDS Start-End: 10-672
aacttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctgcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctagggtgtcgctctgctggcctggccggcaaccccagttctgctcctctccaggcacccttctttcctcttccccttgcccttgccctgacctcccagccctat

SEQ ID NO: 166801 - DNA, 655 bp, Homo sapiens
  Payload ID: 12838
  Gene Symbol: PMF1-BGLAP
  Gene Name: PMF1-BGLAP readthrough
  ENST ID: ENST00000567140
  CDS Start-End: 8-436
cttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcaggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctagggtgtcgctctgctggcctggccggcaaccccagttctgctcctctccaggc

SEQ ID NO: 166802 - DNA, 1007 bp, Homo sapiens
  Payload ID: 12838
  Gene Symbol: PMF1-BGLAP
  Gene Name: PMF1-BGLAP readthrough
  ENST ID: ENST00000490491
  CDS Start-End: 35-670
ccgggccagttagatttggaggttcaacttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctagggtgtcgctctgctggcctggccggcaaccccagttctgctcctctccaggcacccttctttcctcttccccttgcccttgccctgacctcccagccctatggatgtggggtccccatcatcccagctgctcccaaataaactccagaagaggaatctgtgggcctgtga

SEQ ID NO: 166803 - DNA, 2667 bp, Homo sapiens
  Payload ID: 12839
  Gene Symbol: PRAM1
  Gene Name: PML-RARA regulated adaptor molecule 1
  Uniprot ID: Q96QH2
  ENST ID: ENST00000423345
  CDS Start-End: 522-2534
aagcttgggacagtagcaggcaggacaggaattcaagcgaaatagaagtgcccagcaggggccggggcagtggctcacacctgtaatcccagcactttggtaggccgaggcggaccgatcccttgaggtcaggagtttgagaccagcctgcccaacatggtgaaaccccttctctactaaagatacgaaaagtagccaggagcggtggtgcgcgcctgtaatcccagctactcaggaggttgatgcaaaagaattgcctgaacccgggaggcagaggttgcagtgagccgagatggcaccatggcactccagcctgggcgacagagcaagactcagtctcaaaaaaaaagaagtggctggcaggatctggagacggactggagcctccccacctccttcccttcctcctctgccctcccccgccccacctctagcagcccccaccctgtgtgctgaccgtggagcagaagccacagtcacttcctgaaggcagcggccccagctcgggtcccactcatcccatggcccatcacctgcctgcagccatggagagccatcaggacttccggagcatcaaagcaaagttccaggcctctcagccggagcccagcgacctgcccaaaaaacctccgaagcctgagtttggtaaactgaagaagttctcccagcctgagctaagcgagcaccccaagaaggccccgctgcctgagtttggtgcagtgtccttgaagcccccgccgcctgaggtcactgacctccccaagaagcccccgccgcctgaggtcactgacctccccaagaagcccccgccgcctgaggtcactgacctccccaagaagcccccgccgcctgaggtcactgacctccccaagaagccgtccaaactggagttgagtgacctctccaagaagttcccacagctgggggccactccgtttccaaggaagcccctgcagcctgaggtcggtgaggcccctttgaaggcctcgctgccggagcctggtgcgccggcccggaaacccctgcagcccgacgaactcagtcaccccgccagacccccctccgaacccaaatccggcgcattccccaggaagctctggcaacccgaggccggtgaggctaccccgaggtccccgcagcctgagttgagtacctttcccaagaagcctgcgcagcctgagttcaacgtgtaccccaaaaagcctccgcagcctcaggtcggtggcctccctaagaagtccgtgccgcagcctgagttcagcgaggccgctcagactcccctctggaagcctcagtccagcgagccgaagcgcgactccagcgcctttcccaaaaaggcctcccagcctccgctgagtgactttcccaagaagcctccgcagcctgagcttggggacctcaccaggacctcctcagagcccgaagtcagcgtgcttcccaagaggccgcggccggccgaattcaaagcgctctccaagaagcccccgcagcccgagctgggcggcctccccaggacctcctcagagcccgagttcaactcactccccaggaagctgctgcagccggagcgccgggggccaccccgcaagttctcacagcctgagcccagcgctgtcctcaagagacacccgcagcctgagttcttcggtgatctccctcgaaagcctccactccccagctccgcttccgagagctcactgcctgcggccgtggccggcttcagctcccggcacccgctcagccctgggtttggagcggctgggacaccccgctggaggtcaggaggcctggttcacagtggaggggccaggccaggcctcagacccagccatccaccccggcggaggcctctgccccctgccagcagcctgggacaccctccagccaagcccccgctgcccccggggcccgtggatatgcagagctttcggagaccctctgcagcatccatagatctacggaggacccgctcggccgctgggctccacttccaggaccgacagcctgaagacatcccgcaggtcccagatgagatctacgagctgtatgacgatgtggaacccagagatgactccagccccagccccaagggcagagatgaagcgccctcagttcagcaagccgccaggaggccaccacaagacccagcgctcaggaaggagaaggatccccagccacagcagttgccacccatggacccaaagttgctgaagcagctgaggaaggcagagaaggccgagagggagttccggaagaagttcaagtttgaaggggagatcgtggttcacacgaagatgatgatcgaccccaacgctaagacacgtcgcgggggtggcaagcacctcgggatccggcgcggggagatcctggaggtgatcgagttcaccagcaatgaggagatgctgtgccgggaccccaaaggcaaatatggctacgtgcccagaacagcgctcctgcccctggagacggaggtgtacgatgatgtcgacttctgcgatcccctggaaaaccaaccactccccctgggacggtaagaccggtaggcgtggggccaggacagccagccagcccagcgcccgctcacccaggagccctggatcccggcgcgggaaagtcacagagctgcctgggcttgtacctggccacataaagccccagtttaaagca

SEQ ID NO: 166804 - DNA, 583 bp, Homo sapiens
  Payload ID: 12839
  Gene Symbol: PRAM1
  Gene Name: PML-RARA regulated adaptor molecule 1
  ENST ID: ENST00000600262
  CDS Start-End: 44-583
acttcctgaaggcagcggccccagctcgggtcccactcatcccatggcccatcacctgcctgcagccatggagagccatcaggacttccggagcatcaaagcaaagttccaggcctctcagccggagcccagcgacctgcccaaaaaacctccgaagcctgagtttggtaaactgaagaagttctcccagcctgagctaagcgagcaccccaagaaggccccgctgcctgagtttggtgcagtgtccttgaagcccccgccgcctgaggtcactgacctccccaagaagcccccgccgcctgaggtcactgacctccccaagaagccgtccaaactggagttgagtgacctctccaagaagttcccacagctgggggccactccgtttccaaggaagcccctgcagcctgaggtcggtgaggcccctttgaaggcctcgctgccggagcctggtgcgccggcccggaaacccctgcagcccgacgaactcagtcaccccgccagacccccctccgaacccaaatccggcgcattccccaggaagctctggcaacccgaggccggtgaggctaccccgaggtcc

SEQ ID NO: 166805 - DNA, 3012 bp, Homo sapiens
  Payload ID: 12840
  Gene Symbol: PMS1
  Gene Name: PMS1 homolog 1, mismatch repair system component
  ENST ID: ENST00000342075
  CDS Start-End: 126-452
gtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 166806 - DNA, 948 bp, Homo sapiens
  Payload ID: 12840
  Gene Symbol: PMS1
  Gene Name: PMS1 homolog 1, mismatch repair system component
  ENST ID: ENST00000374826
  CDS Start-End: 107-604
gtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaagggtctcactctgtcacacaggctggactgcagtggcatcatcttggttcactgcaacctctgcctcccaggctcaagtgatcctcccacctcagcctcctcagtagctgggactacaggtgcataccaccacacccggctaatttttgtatttttagtagagacagggttttgctgtgttgcccagctggcctcgaactcctgagcccaagcgatacacctgccttggcctcccagagtgctgagattacagatgtgagccactgtgttcagctgataagtgtttaaatttctctaaaaactatttacttataaaggtaaaaaagatctctttaggcttcagtttcacatatctcctttaatctttttttaataatttctagtgatgggatgattaagagactattaaagctattacctcttta

SEQ ID NO: 166807 - DNA, 1882 bp, Homo sapiens
  Payload ID: 12840
  Gene Symbol: PMS1
  Gene Name: PMS1 homolog 1, mismatch repair system component
  ENST ID: ENST00000409985
  CDS Start-End: 165-710
agtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtaagaaagtagctttgtatacaaacattctttaccttttctgtcttaattgttggtttaaaaaaaaaaagttactcggtgaatacaaatatattgctttgggcttggtcctgataaaggctagttaacttccaagtaaacattcagcctttattctagccaccaatttcttaaatatttagaattgttctcaaaaggaactgtatgagagactggacacttccatggactagttactcctctgtaaaaactaagagtatttattttaccagtgctggattaccagtgtcatcttcatatatgaagaagattaaaattttattgaaacatataaaacataattgatttggtaatagtggaaataaacgataccatcaagatatgattaaataatttaaaatctatttgttaattgatggaaaacttcaaacatgcataagaagttactgtacttatcactcagtttcaataatttatcaattcattgctaaagttctttcatgtaataccctcgcccatttcttccctttctatattactttgaagcaaatacgtattgtttctacttgtaatgtagttagtgttttatatacttttatgtaatattattacattttaattgatatcttatgttttttattttattttattttattttcctgagacagggtctcactctgtcacacaggctggactgcagtggcatcatcttggttcactgcaacctctgcctcccaggctcaagtgatcctcccacctcagcctcctcagtagctgggactacaggtgcataccaccacacccggctaatttttgtatttttagtagagacagggttttgctgtgttgcccagctggcctcgaactcctgagcccaagcgatacacctgccttggcctcccagagtgctgagattacagatgtgagccactgtgttcagctgataagtgtttaaatttctctaaaaactatttacttataaaggtaaaaaagatctctttaggcttcagtttcacatatctcctttaatctttttttaataatttctagtgatgggatgattaagagactattaaagctattacctctttagagtcatgttcaaaataattattagatctgaaaagggacttgtgggttttgttgttgttgtttatccttctgcttctccaatttgtgttgtaaattcatgtttaattttgtgttccctcattgcagtttatcaaagtacattctgtatattttctgtggtttttttccttcagttttaatattaaattattggattctttttttcaaa

SEQ ID NO: 166808 - DNA, 2795 bp, Homo sapiens
  Payload ID: 12840
  Gene Symbol: PMS1
  Gene Name: PMS1 homolog 1, mismatch repair system component
  Uniprot ID: P54277
  ENST ID: ENST00000409823
  CDS Start-End: 114-2795
ggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatga

SEQ ID NO: 166809 - DNA, 1668 bp, Homo sapiens
  Payload ID: 12840
  Gene Symbol: PMS1
  Gene Name: PMS1 homolog 1, mismatch repair system component
  Uniprot ID: P54277
  ENST ID: ENST00000409593
  CDS Start-End: 1-1668
atgagctttggtatccttaaacctgacttaaggattgtctttgtacataacaagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaatctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatga

SEQ ID NO: 166810 - DNA, 2153 bp, Homo sapiens
  Payload ID: 12840
  Gene Symbol: PMS1
  Gene Name: PMS1 homolog 1, mismatch repair system component
  ENST ID: ENST00000424307
  CDS Start-End: 21-2153
ctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactg

SEQ ID NO: 166811 - DNA, 331 bp, Homo sapiens
  Payload ID: 12840
  Gene Symbol: PMS1
  Gene Name: PMS1 homolog 1, mismatch repair system component
  ENST ID: ENST00000420421
  CDS Start-End: 111-331
gatctattttcatctgtcattattattgccatttgtcctgttggtcaggaatgcttaacaattcttacaagttgcatttttatcttctagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtacta

SEQ ID NO: 166812 - DNA, 881 bp, Homo sapiens
  Payload ID: 12840
  Gene Symbol: PMS1
  Gene Name: PMS1 homolog 1, mismatch repair system component
  ENST ID: ENST00000452382
  CDS Start-End: 84-881
gaaggtagagcaaaaatgatacaacacccaagaatcgtactagctaccatttctcttcctgtctttatcttggagttctgtccatgatcctaaattctctaagatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagag

SEQ ID NO: 166813 - DNA, 3234 bp, Homo sapiens
  Payload ID: 12840
  Gene Symbol: PMS1
  Gene Name: PMS1 homolog 1, mismatch repair system component
  ENST ID: ENST00000432292
  CDS Start-End: 772-3042
ggcaagacaacgaggatttgcgtagggggcgagcctctgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattc

SEQ ID NO: 166814 - DNA, 2576 bp, Homo sapiens
  Payload ID: 12840
  Gene Symbol: PMS1
  Gene Name: PMS1 homolog 1, mismatch repair system component
  Uniprot ID: P54277
  ENST ID: ENST00000447232
  CDS Start-End: 71-2383
gctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaatctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattca

SEQ ID NO: 166815 - DNA, 3018 bp, Homo sapiens
  Payload ID: 12840
  Gene Symbol: PMS1
  Gene Name: PMS1 homolog 1, mismatch repair system component
  ENST ID: ENST00000418224
  CDS Start-End: 530-2533
ggcaagacaacgaggatttgcgtagggggcgagcctctgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattc

SEQ ID NO: 166816 - DNA, 2817 bp, Homo sapiens
  Payload ID: 12840
  Gene Symbol: PMS1
  Gene Name: PMS1 homolog 1, mismatch repair system component
  ENST ID: ENST00000450931
  CDS Start-End: 199-2178
gggttgggcctgcgcatcgggtgagacgctggctgcttgcggctagtggatggcacacctgttgtccttaactgactttccgggtcatcagcacttcttcagaagtgttccttttccctcccagcaaatatggaagactgactatcctgatattcccagacattctttgctgtgatttctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatgtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 166817 - DNA, 3225 bp, Homo sapiens
  Payload ID: 12840
  Gene Symbol: PMS1
  Gene Name: PMS1 homolog 1, mismatch repair system component
  Uniprot ID: P54277
  ENST ID: ENST00000441310
  CDS Start-End: 234-3032
agactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattca

SEQ ID NO: 166818 - DNA, 831 bp, Homo sapiens
  Payload ID: 12840
  Gene Symbol: PMS1
  Gene Name: PMS1 homolog 1, mismatch repair system component
  ENST ID: ENST00000424766
  CDS Start-End: 249-831
ggctgcttgcggctagtggatggtaattgcctgcctcgcgctagcaggaaggtagtgtggtgtgactaacgggtatttattatatcctcgatggctcgagggccccgtcccctctactcgtcctggtccgggcgcgaacgctatagggcagctaagggcgctccccgcggggcgggaagcgaagccgggcttgcgggcgcgcacacgtggaacgcgttttctgagcagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaagg

SEQ ID NO: 166819 - DNA, 570 bp, Homo sapiens
  Payload ID: 12840
  Gene Symbol: PMS1
  Gene Name: PMS1 homolog 1, mismatch repair system component
  ENST ID: ENST00000447734
  CDS Start-End: 50-193
gtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaa

SEQ ID NO: 166820 - DNA, 560 bp, Homo sapiens
  Payload ID: 12840
  Gene Symbol: PMS1
  Gene Name: PMS1 homolog 1, mismatch repair system component
  ENST ID: ENST00000446877
  CDS Start-End: 429-560
gtgctgggtgcgggtgcgggtgcggggttgggcctgcgcatcgggtgagacgctggctgcttgcggctagtggatggtaattgcctgcctcgcgctagcaggaaggtagtgtggtgtgactaacgggtatttattatatcctcgatggctcgagggccccgtcccctctactcgtcctggtccgggcgcgaacgctatagggcagctaagggcgctccccgcggggcgggaagcgaagccgggcttgcgggcgcgcacacgtggaacgcgttttctgagcaggcacacctgttgtccttaactgactttccgggtcatcagcacttcttcagaagtgttccttttccctcccagcaaatatggaagactgactatcctgatattcccagacattctttgctgtgatttctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactg

SEQ ID NO: 166821 - DNA, 1468 bp, Homo sapiens
  Payload ID: 12840
  Gene Symbol: PMS1
  Gene Name: PMS1 homolog 1, mismatch repair system component
  ENST ID: ENST00000618056
  CDS Start-End: 530-1276
ggcaagacaacgaggatttgcgtagggggcgagcctctgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattc

SEQ ID NO: 166822 - DNA, 3417 bp, Homo sapiens
  Payload ID: 12840
  Gene Symbol: PMS1
  Gene Name: PMS1 homolog 1, mismatch repair system component
  ENST ID: ENST00000624204
  CDS Start-End: 955-3225
ggcaagacaacgaggatttgcgtagggggcgagcctctgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattc

SEQ ID NO: 166823 - DNA, 2855 bp, Homo sapiens
  Payload ID: 12841
  Gene Symbol: PMS2
  Gene Name: PMS1 homolog 2, mismatch repair system component
  Uniprot ID: P54278
  ENST ID: ENST00000265849
  CDS Start-End: 107-2695
ggagcacaacgtcgaaagcagccaatgggagttcaggaggcggagcgcctgtgggagccctggagggaactttcccagtccccgaggcggatcgggtgttgcatccatggagcgagctgagagctcgagtacagaacctgctaaggccatcaaacctattgatcggaagtcagtccatcagatttgctctgggcaggtggtactgagtctaagcactgcggtaaaggagttagtagaaaacagtctggatgctggtgccactaatattgatctaaagcttaaggactatggagtggatcttattgaagtttcagacaatggatgtggggtagaagaagaaaacttcgaaggcttaactctgaaacatcacacatctaagattcaagagtttgccgacctaactcaggttgaaacttttggctttcggggggaagctctgagctcactttgtgcactgagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttccgatgctctgcataatcttttttacatctcaggtttcatttcacaatgcacgcatggagttggaaggagttcaacagacagacagtttttctttatcaaccggcggccttgtgacccagcaaaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctaaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccaga

SEQ ID NO: 166824 - DNA, 1386 bp, Homo sapiens
  Payload ID: 12841
  Gene Symbol: PMS2
  Gene Name: PMS1 homolog 2, mismatch repair system component
  Uniprot ID: P54278
  ENST ID: ENST00000382321
  CDS Start-End: 1-1386
atggagcgagctgagagctcgagtacagaacctgctaaggccatcaaacctattgatcggaagtcagtccatcagatttgctctgggcaggtggtactgagtctaagcactgcggtaaaggagttagtagaaaacagtctggatgctggtgccactaatattgatctaaagcttaaggactatggagtggatcttattgaagtttcagacaatggatgtggggtagaagaagaaaacttcgaaggcttaactctgaaacatcacacatctaagattcaagagtttgccgacctaactcaggttgaaacttttggctttcggggggaagctctgagctcactttgtgcactgagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttccgatgctctgcataatcttttttataaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactga

SEQ ID NO: 166825 - DNA, 2730 bp, Homo sapiens
  Payload ID: 12841
  Gene Symbol: PMS2
  Gene Name: PMS1 homolog 2, mismatch repair system component
  ENST ID: ENST00000441476
  CDS Start-End: 303-2573
agccaatgggagttcaggaggcggagcgcctgtgggagccctggagggaactttcccagtccccgaggcggatcgggtgttgcatccatggagcgagctgagagctcgagtacagaacctgctaaggccatcaaacctattgatcggaagtcagtccatcagatttgctctgggcaggtggtactgagtctaagcactgcggtaaaggagttagtagaaaacagtctggatgctggtgccactaatattgatctaaagcttaaggactatggagtggatcttattgaagtttcagacaatggatgtggggtagaagaagaaaacttcgaaggcttaacgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttccgatgctctgcataatcttttttacatctcaggtttcatttcacaatgcacgcatggagttggaaggagttcaacagacagacagtttttctttatcaaccggcggccttgtgacccagcaaaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctaaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaacc

SEQ ID NO: 166826 - DNA, 5112 bp, Homo sapiens
  Payload ID: 12842
  Gene Symbol: PNISR
  Gene Name: PNN-interacting serine/arginine-rich protein
  Uniprot ID: Q8TF01
  ENST ID: ENST00000369239
  CDS Start-End: 206-2623
atcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcctgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacagaaaaattctgttggctatgatatgcacatttttgggcaagttatgaactagagccaaaagtagtatttgacagttttatttactctgccgtaatttgcaagcttatcagttaagtctgtagtttttttaaaagccgtcatgatatttgtgattattagtacataaaccagtgttataatttgatatttgggtttttcagacttttagtggcagatttagagaattctttattttcttgacatgtgatatagtatttatttaccttgagtggtaaggttttataaggtagggtttccatgatttaggatgtgaatgcaaaaacttacacataagttaattagatgtataatttggttatgaaatcttttctaaaataataccaccagaaaattaacagatcaaatttttgagacaatccttggtctggattggttaatgaaaatgtcttgtttaagaggttctattaaaaaatatttctagtgtattagtcataattgtttttgtggagtgggggtaaaccacaccattaagggaataaaatgtaatttgaaagaggtgattataagatttgtttcaggccccaaaatataaataaaaattggtgtggaatct

SEQ ID NO: 166827 - DNA, 3142 bp, Homo sapiens
  Payload ID: 12842
  Gene Symbol: PNISR
  Gene Name: PNN-interacting serine/arginine-rich protein
  Uniprot ID: Q8TF01
  ENST ID: ENST00000438806
  CDS Start-End: 149-2566
ccgggtgagacaaatcgggcgccatcttgtcttgttcccgaagaagtagaagcatcgaaagcgttggagaggtgttaccggaacggcggcgacaagggtgttcccgaactagagtggatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaa

SEQ ID NO: 166828 - DNA, 2422 bp, Homo sapiens
  Payload ID: 12842
  Gene Symbol: PNISR
  Gene Name: PNN-interacting serine/arginine-rich protein
  Uniprot ID: Q8TF01
  ENST ID: ENST00000478777
  CDS Start-End: 206-1447
atcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaaggtatattttggtgtttctggttttgcttttcctggggtattttggttctgatgactattttggcctttttttgttgtccttgttggatttctaccagatatttgaatattctcttgcatgttttaactcttaaagattagattcgtagacaccatattaaagctatacaaatatttttgttttatctgacctacatgagtacaaattagcaatcatgctgttttcctctaaaatgtattgtggaaaattccaggtgttcagtttatttcacctgattttttttaatagataacatggcattgttgtgtgacttctgatacagtttattttgactaatgaattttgaattatctacctacaatttttagtttaccacttatctcttacagaagcaagtgatttcctacccctagatttttagtaacaccttaaaaatgtattgaaaacaaaaattaagttacatgtcataatctcagaagtagacatacagatatacctgtcaacattttttctcattataaaccaatttcagctcacatcagagttataatttcaaagccagacatgatactggtttaaaatgaatgttatgtttttaatgtttcttctctccccaaaaagcagcaatagtagtagatttaacaataccatagactcatgactatgaaatcgtggctatttgtgttaacatgttgttcctgttgttgatgtgatacaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcat

SEQ ID NO: 166829 - DNA, 1898 bp, Homo sapiens
  Payload ID: 12843
  Gene Symbol: POC1A
  Gene Name: POC1 centriolar protein A
  Uniprot ID: Q8NBT0
  ENST ID: ENST00000296484
  CDS Start-End: 41-1264
aacggccaccgcagctgccttcggcgccgccagccccgccatggctgcgccctgcgcggaggacccctcgctggaaaggcattttaagggccaccgagatgcagttacctgtgtggacttcagtatcaacacaaagcagctggccagtggctccatggactcatgcctcatggtctggcacatgaagccgcagtcacgcgcctaccgcttcactggccacaaggatgccgtcacctgtgtgaacttctctccttcgggacacctgcttgcttccggctcccgagacaagactgtccgcatctgggtacccaatgtcaaaggtgagtccactgtgtttcgtgcacacacagccacagtgaggagtgtccacttctgcagtgatggccagtccttcgtgacagcctctgacgacaagacagtcaaagtgtgggcaactcatcgccagaaattcctgttctccctgagccagcatatcaactgggtccgctgtgccaagttctcccccgacgggcggctcatcgtgtctgccagtgatgacaagactgttaagctgtgggacaagagcagccgggaatgtgtccactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctctttccacccgtcgggaaactacctgatcacagcctccagtgactcaaccctgaagatcctggacctgatggagggccggctgctctacacactccacgggcatcagggaccagccaccactgttgccttttcaagaacgggggagtattttgcttctggaggctctgatgaacaagtgatggtttggaagagtaactttgatattgttgatcatggagaagtcacgaaagtgccgaggcccccagccacactggccagctccatggggaatctgccagaagtggacttccctgtccccccaggcagaggcaggagtgtggagtctgtgcagagccagccccaggagcccgtgagtgtgccccagacactgactagcacgctggagcacattgtgggccagctggatgtcctcactcagacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccatgggacttgggtaaataaaggggactgaactctgtgggaatcacatccatactggagccctggatttttgcagttctgccctccaccttgctatctgcaccaggaggctctccacctggcagccagaggtccccagtgggccgggctcacacacaaatgatgcttcagacccgaatgagaggaccacattttgcttaatgtaaaggagccacttgaaaatgtctgctccttcggggtcctgagattgtggctccccctctggaggaggtggctccacgatgccttgattttcactcatcatttggacatgtgactggcttttcctacctctgccatggtgtagaaattgattgcacattgattggatgagccgggggttttctctaaatctgactaaaggcccaaagtgggcccatctgagtcaggtttgttgagaacaagccctctcaagtgggtggtggcttttcagtggccctgatttctgttccacacgtgttcactggagccaggtgacttcctccttgcgtgagtgagggcacaggaatctcaaaattaaacctgacttcattgca

SEQ ID NO: 166830 - DNA, 1999 bp, Homo sapiens
  Payload ID: 12843
  Gene Symbol: POC1A
  Gene Name: POC1 centriolar protein A
  Uniprot ID: Q8NBT0
  ENST ID: ENST00000394970
  CDS Start-End: 319-1398
gggctggtggggtgaacccttcatcctgggtcttttaatttctcaggcggaacgagtggcggcggacagaggcttttggctgcgctgtctgtgggttgtctgggcttggggaactgggcacggagaccgtggcgccggccgccggtcatacagctctgcttccagtcgtcgggcaaaaagctgaggcgcttctcctttaattgcggtgggcggggcgtgccgacgcggcccgcgttgctattggtggccgttgggggcgcggaaactgaacgggccgcaacggccaccgcagctgccttcggcgccgccagccccgccatggctgcgccctgcgcggaggacccctcgctggaaaggcattttaagggccaccgagatgcagttacctgtgtggacttcagtatcaacacaaagcagctggccagtggctccatggactcatgcctcatggtctggcacatgaagccgcagtcacgcgcctaccgcttcactggccacaaggatgccgtcacctgtgtgaacttctctccttcgggacacctgcttgcttccggctcccgagacaagactgtccgcatctgggtacccaatgtcaaaggtgagtccactgtgtttcgtgcacacacagccacagtgaggagtgtccacttctgcagtgatggccagtccttcgtgacagcctctgacgacaagacagtcaaagtgtgggcaactcatcgccagaaattcctgttctccctgagccagcatatcaactgggtccgctgtgccaagttctcccccgacgggcggctcatcgtgtctgccagtgatgacaagactgttaagctgtgggacaagagcagccgggaatgtgtccactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctctttccacccgtcgggaaactacctgatcacagcctccagtgactcaaccctgaagatcctggacctgatggagggccggctgctctacacactccacgggcatcagggaccagccaccactgttgccttttcaagaacgggggagtattttgcttctggaggctctgatgaacaagtgatggtttggaagagtaactttgatattgttgatcatggagaagtcacgaaagtgccgaggcccccagccacactggccagctccatggggaatctgacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccatgggacttgggtaaataaaggggactgaactctgtgggaatcacatccatactggagccctggatttttgcagttctgccctccaccttgctatctgcaccaggaggctctccacctggcagccagaggtccccagtgggccgggctcacacacaaatgatgcttcagacccgaatgagaggaccacattttgcttaatgtaaaggagccacttgaaaatgtctgctccttcggggtcctgagattgtggctccccctctggaggaggtggctccacgatgccttgattttcactcatcatttggacatgtgactggcttttcctacctctgccatggtgtagaaattgattgcacattgattggatgagccgggggttttctctaaatctgactaaaggcccaaagtgggcccatctgagtcaggtttgttgagaacaagccctctcaagtgggtggtggcttttcagtggccctgatttctgttccacacgtgttcactggagccaggtgacttcctccttgcgtgagtgagggcac

SEQ ID NO: 166831 - DNA, 1760 bp, Homo sapiens
  Payload ID: 12843
  Gene Symbol: POC1A
  Gene Name: POC1 centriolar protein A
  Uniprot ID: Q8NBT0
  ENST ID: ENST00000474012
  CDS Start-End: 218-1327
ccgcagctgccttcggcgccgccagccccgccatggctgcgccctgcgcggaagagtgctggccctggggaagccccttcctcacccaggcttcacacatttgaccctggctctctctcaggaggacccctcgctggaaaggcattttaagggccaccgagatgcagttacctgtgtggacttcagtatcaacacaaagcagctggccagtggctccatggactcatgcctcatggtctggcacatgaagccgcagtcacgcgcctaccgcttcactggccacaaggatgccgtcacctgtgtgaacttctctccttcgggacacctgcttgcttccggctcccgagacaagactgtccgcatctgggtacccaatgtcaaaggtgagtccactgtgtttcgtgcacacacagccacagtgaggagtgtccacttctgcagtgatggccagtccttcgtgacagcctctgacgacaagacagtcaaagtgtgggcaactcatcgccagaaattcctgttctccctgagccagcatatcaactgggtccgctgtgccaagttctcccccgacgggcggctcatcgtgtctgccagtgatgacaagactgttaagctgtgggacaagagcagccgggaatgtgtccactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctctttccacccgtcgggaaactacctgatcacagcctccagtgactcaaccctgaagatcctggacctgatggagggccggctgctctacacactccacgggcatcagggaccagccaccactgttgccttttcaagaacgggggagtattttgcttctggaggctctgatgaacaagtgatggtttggaagagtaactttgatattgttgatcatggagaagtcacgaaagtgccgaggcccccagccacactggccagctccatggggaatctgccagaagtggacttccctgtccccccaggcagaggcaggagtgtggagtctgtgcagagccagccccaggagcccgtgagtgtgccccagacactgactagcacgctggagcacattgtgggccagctggatgtcctcactcagacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccatgggacttgggtaaataaaggggactgaactctgtgggaatcacatccatactggagccctggatttttgcagttctgccctccaccttgctatctgcaccaggaggctctccacctggcagccagaggtccccagtgggccgggctcacacacaaatgatgcttcagacccgaatgagaggaccacattttgcttaatgtaaaggagccacttgaaaatgtctgctccttcggggtcctgagattgtggctccccctctggaggaggtggctccacgatgccttgattttcactcatcatttggacatgtgactggcttttcctacctctgccatggtgtagaaattgattgcacattgattggatgagc

SEQ ID NO: 166832 - DNA, 3001 bp, Homo sapiens
  Payload ID: 12844
  Gene Symbol: POC1B
  Gene Name: POC1 centriolar protein B
  Uniprot ID: Q8TC44
  ENST ID: ENST00000313546
  CDS Start-End: 130-1566
gaccgggaggcgctgccgctctgggcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttgctactgcttcttgggatacctttctcatgctatggaatttcaagccacatgctagagcttacagatatgtgggtcacaaggatgttgtaaccagcgtgcagttttctccacatggaaacttattggcgtctgcctcacgagacagaaccgtgagactctggattcctgataagagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaattttcacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatccttcgggtaactatctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttccccatattattttaaatgtccattttcatttataggccaaatcctgccaggaaagtaaccagatctctggatttcactgttaagtcatttcagattgaccatattcagacagtcatggggtgaaataattcacttacctccaaaatagcatcctatatgccaataatgagttattgatctgactagttgtatgtctttctgttcaaaatagaaattatcctttcttactaatgccttgaaagaatgaacaaataaaaattcccagaccacagaatttccacagcaagaatacacttattttaattaacaatagcacagatatagcatagggcagtgggttttttagttaatttatggcgtactttgtttatccattggccaacctgaaggaaatgaaactcacctatctttctatcacagatgaatgtgctagatgaatgatttgggttgtatctgatcatggttcacaaaaattatgttagtgtgttttcagtatgctaaaaagtcagagtgatacaaaagtgatatttaaaaatatacacacatgtatgtacacatgcttcagaaatattgttgcttagggtgatttgggcagctaaatagtaagtactttttaaaatttttgcatcatcatcttcctatttaatgaattgtgatttaaaacaaaatgaaaataagccaggtattctaaaagatcctggatacaaattaagaattttgctttattttaaaccaaattgagattaaattgaagaaaagcaagcaaattaatttcagcttgattatcaacctgtatcaagaacaaaaatgggaggaggtgtccacatttatggtgtgtataggtaacatggggaaaatgctattctgtgttttggaaaagaagaaatagtgccgtcctatttatttctatatttagaaatttttctcaaagaaatttcaattgtatctatgagatgggtttctaagtatcttattgtgtgttataagtgccttttaatatcatactaagtgtgagcttctggacattttcaagagcttacaaaaactaagtggcattgtatttttataaccccattgagaagactaagtaagaaatgaaatgtcctatcaattttattttgtcatgcttcaaacaataaagacatttctgctttaaaagaaaaa

SEQ ID NO: 166833 - DNA, 3096 bp, Homo sapiens
  Payload ID: 12844
  Gene Symbol: POC1B
  Gene Name: POC1 centriolar protein B
  ENST ID: ENST00000393179
  CDS Start-End: 615-1661
tctcggagggtttccgtggagcgcctgcgtcagaatcacctaggaagtattaaaaaaaaaaaaagtaccaaagccgaggcgcatcctcgcacctgcctgccttgggccagcgggcggggcccgggaacgtgcatttcaaaggggccgcggttcctgcgatgcgctggactctgggaagcgcgaacagagcgttttgcgggctctgcggggagagctggcgccggcgtctccctgtagcaggactgggcgccgcgcccgtgggtgggctgctgcccggccccgccgcccagccaagccgccgcctgggtggccattcccaagccggactccggggaagtggcagcgtggatcccagccgccagaattcgaggtctgcggcggctttcaaaacttgacaactttcctttccaggaggaccccgttctggagcgttatttcaaaggccacaaagctgcgatcacctccttggacctcagccccaacggcaagcaacttggagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaattttcacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatccttcgggtaactatctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttccccatattattttaaatgtccattttcatttataggccaaatcctgccaggaaagtaaccagatctctggatttcactgttaagtcatttcagattgaccatattcagacagtcatggggtgaaataattcacttacctccaaaatagcatcctatatgccaataatgagttattgatctgactagttgtatgtctttctgttcaaaatagaaattatcctttcttactaatgccttgaaagaatgaacaaataaaaattcccagaccacagaatttccacagcaagaatacacttattttaattaacaatagcacagatatagcatagggcagtgggttttttagttaatttatggcgtactttgtttatccattggccaacctgaaggaaatgaaactcacctatctttctatcacagatgaatgtgctagatgaatgatttgggttgtatctgatcatggttcacaaaaattatgttagtgtgttttcagtatgctaaaaagtcagagtgatacaaaagtgatatttaaaaatatacacacatgtatgtacacatgcttcagaaatattgttgcttagggtgatttgggcagctaaatagtaagtactttttaaaatttttgcatcatcatcttcctatttaatgaattgtgatttaaaacaaaatgaaaataagccaggtattctaaaagatcctggatacaaattaagaattttgctttattttaaaccaaattgagattaaattgaagaaaagcaagcaaattaatttcagcttgattatcaacctgtatcaagaacaaaaatgggaggaggtgtccacatttatggtgtgtataggtaacatggggaaaatgctattctgtgttttggaaaagaagaaatagtgccgtcctatttatttctatatttagaaatttttctcaaagaaatttcaattgtatctatgagatgggtttctaagtatcttattgtgtgttataagtgccttttaatatcatactaagtgtgagcttctggacattttcaagagcttacaaaaactaagtggcattgtatttttataaccccattgagaagactaagtaagaaatgaaatgtcctatcaattttattttgtcatgcttcaaacaataaagacatttctgctttaaaagaaaaa

SEQ ID NO: 166834 - DNA, 1392 bp, Homo sapiens
  Payload ID: 12844
  Gene Symbol: POC1B
  Gene Name: POC1 centriolar protein B
  ENST ID: ENST00000547496
  CDS Start-End: 106-258
gcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttggagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaattttcacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatccttcgggtaactatctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaagatttttttcttcatcttttgagattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctg

SEQ ID NO: 166835 - DNA, 2038 bp, Homo sapiens
  Payload ID: 12844
  Gene Symbol: POC1B
  Gene Name: POC1 centriolar protein B
  Uniprot ID: Q8TC44
  ENST ID: ENST00000549035
  CDS Start-End: 471-1781
aaaaaaaaaaaagtaccaaagccgaggcgcatcctcgcacctgcctgccttgggccagcgggcggggcccgggaacgtgcatttcaaaggggccgcggttcctgcgatgcgctggactctgggaagcgcgaacagagcgttttgcgggctctgcggggagagctggcgccggcgtctccctgtagcaggactgggcgccgcgcccgtgggtgggctgctgcccggccccgccgcccagccaagccgccgcctgggtggccattcccaagccggactccggggaagtggcagcgtggatcccagccgccagaattcgaggtctgcggcggctttcaaaacttgacaactttcctttccaggaggaccccgttctggagcgttatttcaaaggccacaaagctgcgatcacctccttggacctcagccccaacggcaagcaacttgctactgcttcttgggatacctttctcatgctatggaatttcaagccacatgctagagcttacagatatgtgggtcacaaggatgttgtaaccagcgtgcagttttctccacatggaaacttattggcgtctgcctcacgagacagaaccgtgagactctggattcctgataagagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaattttcacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatccttcgggtaactatctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagc

SEQ ID NO: 166836 - DNA, 550 bp, Homo sapiens
  Payload ID: 12844
  Gene Symbol: POC1B
  Gene Name: POC1 centriolar protein B
  ENST ID: ENST00000546830
  CDS Start-End: 106-381
gcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttgctactgcttcttgggatacctttctcatgctatggaatttcaagccacatgctagagcttacagatatgtgggtcacaaggatgttgtaaccagcgtgcagttttctccacatggaaacttattggcgtctgcctcacgagacagaaccgtgagactctggattcctgataagtaagagaaacaaagaaacacttgatatcctttggatttggaaatgtgaaagaaagctgaccctggctgctgctcatgcactgctgcctgcactgttattctcagtcacataaaaggcatgctgcccttgtggagaggaaaattctcagaatttaaagctcatacagctccag

SEQ ID NO: 166837 - DNA, 473 bp, Homo sapiens
  Payload ID: 12844
  Gene Symbol: POC1B
  Gene Name: POC1 centriolar protein B
  ENST ID: ENST00000547274
  CDS Start-End: 126-278
gggaggcgctgccgctctgggcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttggagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaattagaacaagagagtttagaccaatgtctggagggcctgattgaccaccaaggcccagcctcccagag

SEQ ID NO: 166838 - DNA, 829 bp, Homo sapiens
  Payload ID: 12844
  Gene Symbol: POC1B
  Gene Name: POC1 centriolar protein B
  ENST ID: ENST00000548715
  CDS Start-End: 103-255
gacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttggagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaagtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttg

SEQ ID NO: 166839 - DNA, 581 bp, Homo sapiens
  Payload ID: 12844
  Gene Symbol: POC1B
  Gene Name: POC1 centriolar protein B
  ENST ID: ENST00000549504
  CDS Start-End: 205-486
ggaggaccccgttctggagcgttatttcaaaggccacaaagctgcgatcacctccttggacctcagccccaacggcaagcaacttggagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaacaacagaaaccagtggtaggactctgccagacaagggtgaagaggcctgtggatatttcttgaacccttccttaatgtcaccagaatgtttg

SEQ ID NO: 166840 - DNA, 2207 bp, Homo sapiens
  Payload ID: 12845
  Gene Symbol: POC1B-GALNT4
  Gene Name: POC1B-GALNT4 readthrough
  ENST ID: ENST00000547474
  CDS Start-End: 368-496
atcgatcacaggctcacaacgcccttccattcatcgctcttattccagtcctggttactaccccacttcctgacatcaaaccagggagaacgcgagtgttagttaacatggcttggtgtgtggccacagctgacccggcgcatacctcccgtcctctctttacagggctggcggtgtctcggggctcggctggccatgcctggagcgcggggtttgactgggccgccgttgttgtagtgaccgggaggcgctgccgctctgggcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttggaaagggacaggcggatatcaagaattgaccccatcagatcacctaccatggctggaggactgtttgctgtcagcaagaaatattttcagtaccttggaacgtatgacacaggaatggaagtgtggggaggtgaaaaccttgagctgtcttttagggtgtggcagtgtggtggcaaattggagatccacccgtgttcccacgtgggccatgtgttccccaagcgggcaccatatgctcgccccaatttcctacagaatactgctcgggcagcagaagtttggatggatgaatacaaagagcacttctacaatagaaaccctccagcaagaaaagaagcttatggtgatatttctgaaagaaaattactacgagagcggttgagatgcaagagctttgactggtatttgaaaaacgtttttcctaatttacatgttccagaggatagaccaggctggcatggggctattcgcagtagagggatctcgtctgaatgtttagattataattctcctgacaacaaccccacaggtgctaacctttcactgtttggatgccatggtcaaggaggcaatcaattctttgaatatacttcaaacaaagaaataaggtttaattctgtgacagagttatgtgcagaggtacctgagcaaaaaaattatgtgggaatgcaaaattgtcccaaagatgggttccctgtaccagcaaacattatttggcattttaaagaagatggaactatttttcacccacactcaggactgtgtcttagtgcttatcggacaccggagggccgacctgatgtacaaatgagaacttgtgatgctctagataaaaatcaaatttggagttttgagaaatagagcacaacagcactttcgtcatgagctgacagtagtgtcaagaaagtcaaagagccttaagagcctcagtgaagattgtattttattttatcaaaagccacctagcagtcatctgtggagcactggaaagctggggttcattttggtatatcacactgaaactgggtacccagagtgctgctgtttaatatttcacaatgccttacttattggttgttttatataagagttttgtcaatatggtctcttcttaaaagaagttgactatgaattgaaacacacaaaacatttaagtgccagacttaatattaaagaatgtaaaggtccaagtaaaatgaggtatgatttatgttgatgtgtaagttcaccgcacatcccactttttaacaaaactcatgaatgtgcagtttgagccattgctattttgattacatagaatttgtatttcttttttagccagcacattaaattttagattttattttttaatctaatttttttctaatcaaaaagaaaattgagcttaaggcaaaaggcctggttttagagatatgtgtaattggaagagggcatttgtttgagtgtgagtttggaggcctttttaacatgcagacatacccatatttaaatgaaatggggagatatttacattccgtactttgtaaacttgagctattggacttcactgatgtatatattaatacctcagattcctctgattttgtaagctgtcttctctgtgaacgtgtttgtgtgtgtagggcattttctgattgcacttccttaagttatgaatgtactagaaagggactcatccagaatactatgcctccctttgttaatgcttaatcatttaaagtaaacacaattgaagcctct

SEQ ID NO: 166841 - DNA, 5436 bp, Homo sapiens
  Payload ID: 12845
  Gene Symbol: POC1B-GALNT4
  Gene Name: POC1B-GALNT4 readthrough
  ENST ID: ENST00000548729
  CDS Start-End: 304-2031
acttcctgacatcaaaccagggagaacgcgagtgttagttaacatggcttggtgtgtggccacagctgacccggcgcatacctcccgtcctctctttacagggctggcggtgtctcggggctcggctggccatgcctggagcgcggggtttgactgggccgccgttgttgtagtgaccgggaggcgctgccgctctgggcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttggagccggccgtgccagggagctggggtcaagaaggctctcagacctccagaaaaatacggaggatttgtctcgaccgctttataagaagccccctgcagattcccgtgcacttggggagtgggggaaagccagcaaactccagctcaacgaggatgaactgaagcagcaagaagaactcattgagagatacgccatcaatatttacctcagtgacaggatttccctgcatcgacacatagaggataaaagaatgtatgagtgtaagtcccagaagttcaactataggacacttcctaccacctctgttatcattgctttctataacgaagcctggtcgactttgctccgtaccattcacagtgttttagaaacttctcctgcagttcttttgaaagagatcatcttggtggatgacttgagtgacagagtttatttgaagacacaacttgaaacttacatcagcaatcttgatagagtacgcttgattaggaccaataagcgagaggggctggttagggcccgtctgattggggccactttcgccactggggacgtcctcactttcctggattgtcactgtgagtgtaattccggttggctggaaccgcttttggaaaggattgggagagatgaaacagcagttgtgtgtcctgttatagacacaattgattggaatacttttgaattctatatgcagataggggagcccatgattggtgggtttgactggcgtttaacatttcagtggcattctgtccccaaacaggaaagggacaggcggatatcaagaattgaccccatcagatcacctaccatggctggaggactgtttgctgtcagcaagaaatattttcagtaccttggaacgtatgacacaggaatggaagtgtggggaggtgaaaaccttgagctgtcttttagggtgtggcagtgtggtggcaaattggagatccacccgtgttcccacgtgggccatgtgttccccaagcgggcaccatatgctcgccccaatttcctacagaatactgctcgggcagcagaagtttggatggatgaatacaaagagcacttctacaatagaaaccctccagcaagaaaagaagcttatggtgatatttctgaaagaaaattactacgagagcggttgagatgcaagagctttgactggtatttgaaaaacgtttttcctaatttacatgttccagaggatagaccaggctggcatggggctattcgcagtagagggatctcgtctgaatgtttagattataattctcctgacaacaaccccacaggtgctaacctttcactgtttggatgccatggtcaaggaggcaatcaattctttgaatatacttcaaacaaagaaataaggtttaattctgtgacagagttatgtgcagaggtacctgagcaaaaaaattatgtgggaatgcaaaattgtcccaaagatgggttccctgtaccagcaaacattatttggcattttaaagaagatggaactatttttcacccacactcaggactgtgtcttagtgcttatcggacaccggagggccgacctgatgtacaaatgagaacttgtgatgctctagataaaaatcaaatttggagttttgagaaatagagcacaacagcactttcgtcatgagctgacagtagtgtcaagaaagtcaaagagccttaagagcctcagtgaagattgtattttattttatcaaaagccacctagcagtcatctgtggagcactggaaagctggggttcattttggtatatcacactgaaactgggtacccagagtgctgctgtttaatatttcacaatgccttacttattggttgttttatataagagttttgtcaatatggtctcttcttaaaagaagttgactatgaattgaaacacacaaaacatttaagtgccagacttaatattaaagaatgtaaaggtccaagtaaaatgaggtatgatttatgttgatgtgtaagttcaccgcacatcccactttttaacaaaactcatgaatgtgcagtttgagccattgctattttgattacatagaatttgtatttcttttttagccagcacattaaattttagattttattttttaatctaatttttttctaatcaaaaagaaaattgagcttaaggcaaaaggcctggttttagagatatgtgtaattggaagagggcatttgtttgagtgtgagtttggaggcctttttaacatgcagacatacccatatttaaatgaaatggggagatatttacattccgtactttgtaaacttgagctattggacttcactgatgtatatattaatacctcagattcctctgattttgtaagctgtcttctctgtgaacgtgtttgtgtgtgtagggcattttctgattgcacttccttaagttatgaatgtactagaaagggactcatccagaatactatgcctccctttgttaatgcttaatcatttaaagtaaacacaattgaagcctctctgaagttaaacccaactatgtttattaaaatgtgtgaaactgaaagtgggctaggttctaccaaggctgtggaactctcctacgagttctgctgatcaggaaatttaagaatttatcttaaaaatgcaaggaaaaaagactgccttggcaattgtgaatggtgctttcaatctcctagcaccgagcctggcacttaggcagctttcagtaagtgggtgaatgaatgactgaatgaatgaatgaatggctcagctgaggaatgtaactttggtcaagttattatgatgtgtttgggcttagttttctcattggtaaaatgtgggtgctggattggatcttaaagatcccttccagctctgaaatgctgattgtacagtatattcttcccagattgactcactgtgcaatctttacaatactttttatcttttcacttttgacataggtaatgttgttgagcagttgagcaatgttcagtccagttgtgaagctggagaagagaaatgggttttaaaaattaagtgaggggaggccgggtgcggtggctcacgcatgtaatcccagcactttgggaggccaaggcaggtggatcacgaggtcaggagatccagaccatcctggctaacatggtgaaacctcgtctctactaaaaatacaaaaaattagccagctgtggtggcgggcgcctgtagtcccagctactcaggaggctgaggcaggagaatggcgtgaacctgtgaggcagagcttacagtgagccgagatcgtgccactgcactccagcctgggcgacagagcaagactctgtctcaaaaaaaaaaaataataataaaataagtgagctgaactcacctgaagtggtttacttctgtgggttaagaagttctagtcagtgttcatagtcgtttcgttttgataattgttgaaccaattttgtttttaaaacctttagactctgaaagtaatattttgactaagaatgtaaatatttccaaactaaattactcgggaagtaaacgctttttttaaaagtatttttactggttttataccaatattatatgcagaaatcacaggatgaatttagaattaaatctcaattagttcactttggcctagatttatgaaaaatgcatgcctcgtaaagagtccactgtattcacgagtaaagttgcttttagtgttcacttgatgacttggagagtaggaattttgcaaaatctgaatttaaggaaattctttaggataaccatttcaaaaaataaaattgctatgcaatcttgaatattttctcttttgcctcgtaaaatgaaaatgcattcacagtttctgtaaattatttagcagccttaaagtttatcaaaaaattgtccagattccacgtgcagcatgcttggccctgcatttaatttaagaaggattaataataatgctctgaatttttcgaaagggattctcctaaacccacccacttctcttgcccaggctgctttttaaaaatatttttttattttttacttatttttaaattttctctttttatttatttttggttttcttgttagccacctgttatatgggagaacgaaaattgttatattttgaaagtacttattacattatttttattttagtatcttgatgctcctgtcaaaagggaaatgaggcttttaaaaataaagtaccttaattctttattgactttttgccctaaattgctaggtgtgacccagcaatcttttaggaagagattttacagtggtgctttatttatatcaataatccagtatagttaggctgttcattcctcataatagagtacataacagaaaagtgggactttcacattttcatatttaggcacgttccaatttaattccaaaaatactctgtaattctacatctaaaaaaaccgattccctaattcgaatttattggtaccaaagctctctttggctatagacaattaagagttgaccttttaagttaatgtatatgcttaaaaacagttttaggaaaatatttggtagacaaagagtttcaactttaaatgttcactatgtcatttagtgtccaactttacggataggttgactatctaaataggcatttttagtcattaaaaaaaatctagtcaccaggaggatccctataactcaaaataacttgtttgtaaaagaaaatttgtttacttacccattagtaagttcctgcatattcattataagatggcaaatcaaacttttctaggatgaagacagcttatttttaagttgtatagtcttagttggtttagggtctcaattttaattaataaaatacttggtttttatttgcttgtccttttgaattcctgttttaataattttaaaatgagcacaaagaacgttgaagttcagattaatctcttctgaatgatgtttttttcctctgtgatgagttgtttctgacttttttccttttgtatttgtaatgttgattaagatgtaaaataaaaagtgtgcctgattatttttgcaaataga

SEQ ID NO: 166842 - DNA, 1728 bp, Homo sapiens
  Payload ID: 12846
  Gene Symbol: POC5
  Gene Name: POC5 centriolar protein
  Uniprot ID: Q8NA72
  ENST ID: ENST00000446329
  CDS Start-End: 72-1724
tgaggtttggtctctgttgtcacaacattcagtacaatctgctgcccaggacctggacattgacagataaaatgaagtgggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtg

SEQ ID NO: 166843 - DNA, 2229 bp, Homo sapiens
  Payload ID: 12846
  Gene Symbol: POC5
  Gene Name: POC5 centriolar protein
  Uniprot ID: Q8NA72
  ENST ID: ENST00000428202
  CDS Start-End: 191-1918
tgaaacaaaggaccaatgcccagggcggtccttaattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaagaaactggactttatttctttaatatgtttagcctgttgctgattacagcatcaaaatatataaatttattttcacta

SEQ ID NO: 166844 - DNA, 1984 bp, Homo sapiens
  Payload ID: 12846
  Gene Symbol: POC5
  Gene Name: POC5 centriolar protein
  ENST ID: ENST00000514838
  CDS Start-End: 108-1751
gtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaagagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaa

SEQ ID NO: 166845 - DNA, 896 bp, Homo sapiens
  Payload ID: 12846
  Gene Symbol: POC5
  Gene Name: POC5 centriolar protein
  ENST ID: ENST00000503835
  CDS Start-End: 411-896
aattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaact

SEQ ID NO: 166846 - DNA, 443 bp, Homo sapiens
  Payload ID: 12846
  Gene Symbol: POC5
  Gene Name: POC5 centriolar protein
  ENST ID: ENST00000506164
  CDS Start-End: 347-443
tgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttc

SEQ ID NO: 166847 - DNA, 401 bp, Homo sapiens
  Payload ID: 12846
  Gene Symbol: POC5
  Gene Name: POC5 centriolar protein
  ENST ID: ENST00000502826
  CDS Start-End: 250-401
ctgtcaggttgccgtctaggtagcggttgtgcttgctgaggctgcacttgctgacactgcagctgcgacgcggctaagaggcgcagagcgaggagtcgggatttggtcgcgagcggcgacggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttc

SEQ ID NO: 166848 - DNA, 785 bp, Homo sapiens
  Payload ID: 12846
  Gene Symbol: POC5
  Gene Name: POC5 centriolar protein
  ENST ID: ENST00000515285
  CDS Start-End: 134-310
gtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcagaaaatattgatgaactcttcatacactctgtacaaaggcttcaaccaacacagtaagaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaaga

SEQ ID NO: 166849 - DNA, 1524 bp, Homo sapiens
  Payload ID: 12846
  Gene Symbol: POC5
  Gene Name: POC5 centriolar protein
  Uniprot ID: Q8NA72
  ENST ID: ENST00000510798
  CDS Start-End: 321-1520
aacattcagtacaatctgctgcccaggacctggacattgacagataaaatgaagaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtg

SEQ ID NO: 166850 - DNA, 2011 bp, Homo sapiens
  Payload ID: 12847
  Gene Symbol: PODXL
  Gene Name: podocalyxin-like
  Uniprot ID: O00592
  ENST ID: ENST00000322985
  CDS Start-End: 251-1831
agacgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccacttcgacgcatcctgtggccaccccaacaagctcgggacatgaccatcttatgaaaatttcaagcagttcaagcactgtggctatccctggctacaccttcacaagcccggggatgaccaccaccctaccgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcatcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtcca

SEQ ID NO: 166851 - DNA, 2105 bp, Homo sapiens
  Payload ID: 12847
  Gene Symbol: PODXL
  Gene Name: podocalyxin-like
  Uniprot ID: O00592
  ENST ID: ENST00000378555
  CDS Start-End: 249-1925
acgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccacttcgacgcatcctgtggccaccccaacaagctcgggacatgaccatcttatgaaaatttcaagcagttcaagcactgtggctatccctggctacaccttcacaagcccggggatgaccaccaccctactagagacagtgtttcaccatgtcagccaggctggtcttgaactcctgacctcgggtgatctgcccaccttggcctcccaaagtgctgggattacagcgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcatcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtcca

SEQ ID NO: 166852 - DNA, 6170 bp, Homo sapiens
  Payload ID: 12847
  Gene Symbol: PODXL
  Gene Name: podocalyxin-like
  ENST ID: ENST00000446198
  CDS Start-End: 205-1179
ctggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccacttcgacgcatcctgtggccaccccaacaagctcgggacatgaccatcttatgaaaatttcaagcagttcaagcactgtggctatccctggctacaccttcacaagcccggggatgaccaccaccctaccgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggtaactccagcaggggtggggcaagtaggagaacccagactcgggtagaagaggctttaagacaaggttttctgttctttcctccaacgcagggcccctggctggggctttgagcagcacttacccattccctcctccctctccctggttagcctggtcctggcttgagctgccctcaagccacgcagccaggacatacctggctctggaatgggtccagccatgcctccagcttgccgtgaactctttcctatctgggtcaccccttagttggggggaaatgtcaaagattccatgactattagcccaaaccttaatctcagtggcttcttccaggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcatcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtccagattcctcttgtaaaataacccactagtgcctgagctcagtgctgctggatgatgagggagatcaagaaaaagccacgtaagggactttatagatgaactagtggaatcccttcattctgcagtgagattgccgagacctgaagagggtaagtgacttgcccaaggtcagagccacttggtgacagagccaggatgagaacaaagattccatttgcaccatgccacactgctgtgttcacatgtgccttccgtccagagcagtcccgggcaggggtgaaactccagcaggtggctgggctggaaaggagggcagggctacatcctggctcggtgggatctgacgacctgaaagtccagctcccaagttttccttctcctaccccagcctcgtgtacccatcttcccaccctctatgttcttacccctccctacactcagtgtttgttcccacttactctgtcctggggcctctgggattagcacaggttattcataaccttgaaccccttgttctggattcggattttctcacatttgcttcgtgagatgggggcttaacccacacaggtctccgtgcgtgaaccaggtctgcttaggggacctgcgtgcaggtgaggagagaaggggacactcgagtccaggctggtatctcagggcagctgatgaggggtcagcaggaacactggcccattgcccctggcactccttgcagaggccacccacgatcttctttgggcttccatttccaccagggactaaaatctgctgtagctagtgagagcagcgtgttccttttgttgttcactgctcagctgatgggagtgattccctgagacccagtatgaaagagcagtggctgcaggagaggccttcccggggccccccatcagcgatgtgtcttcagagacaatccattaaagcagccaggaaggacaggctttcccctgtatatcataggaaactcagggacatttcaagttgctgagagttttgttatagttgttttctaacccagccctccactgccaaaggccaaaagctcagacagttggcagacgtccagttagctcatctcactcactctgattctcctgtgccacaggaaaagagggcctggaaagcgcagtgcatgctgggtgcatgaagggcagcctgggggacagactgttgtgggaacgtcccactgtcctggcctggagctaggccttgctgttcctcttctctgtgagcctagtggggctgctgcggttctcttgcagtttctggtggcatctcaggggaacacaaagctatgtctattccccaatataggacttttatgggctcggcagttagctgccatgtagaaggctcctaagcagtgggcatggtgaggtttcatctgattgagaagggggaatcctgtgtggaatgttgaactttcgccatggtctccatcgttctgggcgtaaattccctgggatcaagtaggaaaatgggcagaactgcttaggggaatgaaattgccatttttcgggtgaaacgccacacctccagggtcttaagagtcaggctccggctgtagtagctctgatgaaataggctatccactcgggatggcttactttttaaaagggtagggggaggggctggggaagatctgtcctgcaccatctgcctaattccttcctcacagtctgtagccatctgatatcctaggggaaaaggaaggccaggggttcacatagggccccagcgagtttcccaggagttagagggatgcgaggctaacaagttccaaaaacatctgccccgatgctctagtgtttggaggtgggcaggatggagaacagtgcctgtttgggggaaaacaggaaatcttgttaggcttgagtgaggtgtttgcttccttcttgcccagcgctgggttctctccacccagtaggttttctgttgtggtcccgtgggagaggccagactggattattcctcctttgctgatcctgggtcacacttcaccagccagggcttttgacggagacagcaaataggcctctgcaaatcaatcaaaggctgcaaccctatggcctcttggagacagatgatgactggcaaggactagagagcaggagtgcctggccaggtcggtcctgactctcctgactctccatcgctctgtccaaggagaacccggagaggctctgggctgattcagaggttactgctttatattcgtccaaactgtgttagtctaggcttaggacagcttcagaatctgacaccttgccttgctcttgccaccaggacacctatgtcaacaggccaaacagccatgcatctataaaggtcatcatcttctgccacctttactgggttctaaatgctctctgataattcagagagcattgggtctgggaagaggtaagaggaacactagaagctcagcatgacttaaacaggttgtagcaaagacagtttatcatcagctctttcagtggtaaactgtggtttccccaagctgcacaggaggccagaaaccacaagtatgatgactaggaagcctactgtcatgagagtggggagacaggcagcaaagcttatgaaggaggtacagaatattctttgcgttgtaagacagaatacgggtttaatctagtctaggcaccagatttttttcccgcttgataaggaaagctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacaggaatgtaaatgtcttactggaaatgacaagtttttgcttgatttttttttttaaacaaaaaatgaaatataacaagacaaacttatgataaagtatttgtcttgtagatcaggtgttttgttttgtttttttaattttaaaatgcaaccctgccccctccccagcaaagtcacagctccatttcagtaaaggttggagtcaatatgctctggttggcaggcaaccctgtagtcatggagaaaggtatttcaagatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaagaattgctactcgaaggtgccagaatgacacaaaggacagaattcctttcccagttgttaccctagcaaggctagggagggcatgaacacaaacataagaactggtcttctacactttctctgaatcatttaggtttaagatgtaagtgaacaattctttctttctgccaagaaacaaagttttggatgagcttttatatatggaacttactccaacaggactgagggaccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgtaaactggttcaa

SEQ ID NO: 166853 - DNA, 2186 bp, Homo sapiens
  Payload ID: 12848
  Gene Symbol: PODXL2
  Gene Name: podocalyxin-like 2
  Uniprot ID: Q9NZ53
  ENST ID: ENST00000342480
  CDS Start-End: 40-1857
cgccgcgccgctgcggctgcaggcggcgacggctacaccatgggccggctgctgcgggccgcccggctgccgccgctgctttcgccgctgctgcttctgctggttgggggagcgttcctgggtgcctgtgtggctgggtctgatgagcctggcccagagggcctcacctccacctccctgctagacctcctgctgcccactggcttggagccactggactcagaggagcctagtgagaccatgggcctgggagctgggctgggagcccctggctcaggcttccccagcgaagagaatgaagagtctcggattctgcagccaccacagtacttctgggaagaggaggaagagctgaatgactcaagtctggacctgggacccactgcagattatgtttttcctgacttaactgagaaggcaggttccattgaagacaccagccaggctcaagagctgccaaacctcccctctcccttgcccaagatgaatctggttgagcctccctggcatatgcctcccagagaggaggaagaagaggaagaggaagaggaggagagggagaaggaagaggtagagaaacaagaggaggaggaagaggaggagctgctccctgtgaatggatcccaagaagaagccaagcctcaggtccgtgacttttctctcaccagcagcagccagaccccaggggccaccaaaagcaggcatgaagactccggggaccaggcctcatcaggtgtggaggtggagagcagcatggggcccagcttgctgctgccttcagtcaccccaactacagtgactccgggggaccaggactccaccagccaagaggcagaggccacagtgctgccagctgcagggcttggggtagagttcgaggctcctcaggaagcaagcgaggaagccactgcaggagcagctggtttgtctggccagcacgaggaggtgccggccttgccttcattccctcaaaccacagctcccagtggggccgagcacccagatgaagatccccttggctctagaacctcagcctcttccccactggcccctggagacatggaactgacaccttcctctgctaccttgggacaagaagatctcaaccagcagctcctagaagggcaggcagctgaagctcaatccaggataccctgggattctacgcaggtgatctgcaaggactggagcaatctggctgggaaaaactacatcattctgaacatgacagagaacatagactgtgaggtgttccggcagcaccgggggccacagctcctggccctggtggaagaggtgctgccccgccatggcagtggccaccatggggcctggcacatctctctgagcaagcccagcgagaaggagcagcaccttctcatgacactggtgggcgagcagggggtggtgcccactcaagatgtcctttccatgctgggtgacatccgcaggagcctggaggagattggcatccagaactattccacaaccagcagctgccaggcgcgggccagccaggtgcgcagcgactacggcacgctcttcgtggtgctggtggtcattggggccatctgcatcatcatcattgcgcttggcctgctctacaactgctggcagcgccggctgcccaagctcaagcacgtgtcgcacggcgaggagctgcgcttcgtggagaacggctgccacgacaaccccacgctggacgtggccagcgacagccagtcggagatgcaggagaagcaccccagcctgaacggcggcggggccctcaacggcccggggagctggggggcgctcatggggggcaagcgggaccccgaggactcggacgtgttcgaggaggacacgcacctgtgagcgcagccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaaagcccgccttggccccgctttcccgcccctgaaccccggccccgcgggcggcgggcggcgcttcctgcgccccgggactcaattaaacccgcccggagaccacgccgggcccagcgcgtctgc

SEQ ID NO: 166854 - DNA, 3010 bp, Homo sapiens
  Payload ID: 12849
  Gene Symbol: PODN
  Gene Name: podocan
  Uniprot ID: Q7Z5L7
  ENST ID: ENST00000312553
  CDS Start-End: 8-1993
gacttgaatggaaggagcccgagcccgcggagcgcagctgagactgggggagcgcgttcggcctgtggggcgccgctcggcgccggggcgcagcaggttccgtcagccctggcgcccaggcgcatctgactcggcaccccctgcaggcaccatggcccagagccgggtgctgctgctcctgctgctgctgccgccacagctgcacctgggacctgtgcttgccgtgagggccccaggatttggccgaagtggcggccacagcctgagccccgaagagaacgaatttgcggaggaggagccggtgctggtactgagccctgaggagcccgggcctggcccagccgcggtcagctgcccccgagactgtgcctgttcccaggagggcgtcgtggactgtggcggtattgacctgcgtgagttcccgggggacctgcctgagcacaccaaccacctatctctgcagaacaaccagctggaaaagatctaccctgaggagctctcccggctgcaccggctggagacgctgaacctgcaaaacaaccgcctgacttcccgagggctcccagagaaggcgtttgagcatctgaccaacctcaattacctgtacttggccaataacaagctgaccttggcaccccgcttcctgccaaacgccctgatcagtgtggactttgctgccaactatctcaccaagatctatgggctcacctttggccagaagccaaacttgaggtctgtgtacctgcacaacaacaagctggcagacgccgggctgccggacaacatgttcaacggctccagcaacgtcgaggtcctcatcctgtccagcaacttcctgcgccacgtgcccaagcacctgccgcctgccctgtacaagctgcacctcaagaacaacaagctggagaagatccccccgggggccttcagcgagctgagcagcctgcgcgagctatacctgcagaacaactacctgactgacgagggcctggacaacgagaccttctggaagctctccagcctggagtacctggatctgtccagcaacaacctgtctcgggtcccagctgggctgccgcgcagcctggtgctgctgcacttggagaagaacgccatccggagcgtggacgcgaatgtgctgacccccatccgcagcctggagtacctgctgctgcacagcaaccagctgcgggagcagggcatccacccactggccttccagggcctcaagcggttgcacacggtgcacctgtacaacaacgcgctggagcgcgtgcccagtggcctgcctcgccgcgtgcgcaccctcatgatcctgcacaaccagatcacaggcattggccgcgaagactttgccaccacctacttcctggaggagctcaacctcagctacaaccgcatcaccagcccgcaggtgcaccgcgacgccttccgcaagctgcgcctgctgcgctcgctggacctgtcgggcaaccggctgcacacgctgccacctgggctgcctcgaaatgtccatgtgctgaaggtcaagcgcaatgagctggctgccttggcacgaggggcgctggtgggcatggctcagctgcgtgagctgtacctcaccagcaaccgactgcgcagccgagccctgggcccccgtgcctgggtggacctcgcccatctgcagctgctggacatcgccgggaatcagctcacagagatccccgaggggctccccgagtcacttgagtacctgtacctgcagaacaacaagattagtgcggtgcccgccaatgccttcgactccacgcccaacctcaaggggatctttctcaggtttaacaagctggctgtgggctccgtggtggacagtgccttccggaggctgaagcacctgcaggtcttggacattgaaggcaacttagagtttggtgacatttccaaggaccgtggccgcttggggaaggaaaaggaggaggaggaagaggaggaggaggaggaagaggaaacaagatagtgacaaggtgatgcagatgtgacctaggacgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgca

SEQ ID NO: 166855 - DNA, 3287 bp, Homo sapiens
  Payload ID: 12849
  Gene Symbol: PODN
  Gene Name: podocan
  Uniprot ID: Q7Z5L7
  ENST ID: ENST00000371500
  CDS Start-End: 342-2270
caaaacttgcgtcgcggagagcgcccagcttgacttgaatggaaggagcccgagcccgcggagcgcagctgagactgggggagcgcgttcggcctgtggggcgccgctcggcgccggggcgcagcagggaaggggaagctgtggtctgccctgctccacgaggcgccactggtgtgaaccgggagagcccctgggtggtcccgtcccctatccctcctttatatagaaaccttccacactgggaaggcagcggcgaggcaggagggctcatggtgagcaaggaggccggctgatctgcaggcgcacagcattccgagtttacagatttttacagataccaaatggaaggcgaggaggcagaacagcctgcctggttccgtcagccctggcgcccaggcgcatctgactcggcaccccctgcaggcaccatggcccagagccgggtgctgctgctcctgctgctgctgccgccacagctgcacctgggacctgtgcttgccgtgagggccccaggatttggccgaagtggcggccacagcctgagccccgaagagaacgaatttgcggaggaggagccggtgctggtactgagccctgaggagcccgggcctggcccagccgcggtcagctgcccccgagactgtgcctgttcccaggagggcgtcgtggactgtggcggtattgacctgcgtgagttcccgggggacctgcctgagcacaccaaccacctatctctgcagaacaaccagctggaaaagatctaccctgaggagctctcccggctgcaccggctggagacgctgaacctgcaaaacaaccgcctgacttcccgagggctcccagagaaggcgtttgagcatctgaccaacctcaattacctgtacttggccaataacaagctgaccttggcaccccgcttcctgccaaacgccctgatcagtgtggactttgctgccaactatctcaccaagatctatgggctcacctttggccagaagccaaacttgaggtctgtgtacctgcacaacaacaagctggcagacgccgggctgccggacaacatgttcaacggctccagcaacgtcgaggtcctcatcctgtccagcaacttcctgcgccacgtgcccaagcacctgccgcctgccctgtacaagctgcacctcaagaacaacaagctggagaagatccccccgggggccttcagcgagctgagcagcctgcgcgagctatacctgcagaacaactacctgactgacgagggcctggacaacgagaccttctggaagctctccagcctggagtacctggatctgtccagcaacaacctgtctcgggtcccagctgggctgccgcgcagcctggtgctgctgcacttggagaagaacgccatccggagcgtggacgcgaatgtgctgacccccatccgcagcctggagtacctgctgctgcacagcaaccagctgcgggagcagggcatccacccactggccttccagggcctcaagcggttgcacacggtgcacctgtacaacaacgcgctggagcgcgtgcccagtggcctgcctcgccgcgtgcgcaccctcatgatcctgcacaaccagatcacaggcattggccgcgaagactttgccaccacctacttcctggaggagctcaacctcagctacaaccgcatcaccagcccgcaggtgcaccgcgacgccttccgcaagctgcgcctgctgcgctcgctggacctgtcgggcaaccggctgcacacgctgccacctgggctgcctcgaaatgtccatgtgctgaaggtcaagcgcaatgagctggctgccttggcacgaggggcgctggtgggcatggctcagctgcgtgagctgtacctcaccagcaaccgactgcgcagccgagccctgggcccccgtgcctgggtggacctcgcccatctgcagctgctggacatcgccgggaatcagctcacagagatccccgaggggctccccgagtcacttgagtacctgtacctgcagaacaacaagattagtgcggtgcccgccaatgccttcgactccacgcccaacctcaaggggatctttctcaggtttaacaagctggctgtgggctccgtggtggacagtgccttccggaggctgaagcacctgcaggtcttggacattgaaggcaacttagagtttggtgacatttccaaggaccgtggccgcttggggaaggaaaaggaggaggaggaagaggaggaggaggaggaagaggaaacaagatagtgacaaggtgatgcagatgtgacctaggacgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgca

SEQ ID NO: 166856 - DNA, 2744 bp, Homo sapiens
  Payload ID: 12849
  Gene Symbol: PODN
  Gene Name: podocan
  Uniprot ID: Q7Z5L7
  ENST ID: ENST00000395871
  CDS Start-End: 169-1728
ttctcctgcccgcgcctggggggaccctacgcctgtgtccgaaggaggccggcgtccagcagatgctcccggggcgggtggggagtgggggaagggggcgggagagaggcggggaggagaaaacccacaacaaaacttgcgtcgcggagagcgcccagcttgacttgaatggaaggagcccgagcccgcggagcgcagctgagactgggggagcgcgttcggcctgtggggcgccgctcggcgccggggcgcagcaggttccgtcagccctggcgcccaggcgcatctgactcggcaccccctgcaggcaccatggcccagagccgggtgctgctgctcctgctgctgctgccgccacagctgcacctgggacctgtgcttgccgtgagggccccaggatttggccgaagtggcggccacagcctgagccccgaagagaacgaatttgcggaggaggagccggtgctggtactgagccctgaggagcccgggcctggcccagccgcggtcagctgcccccgagactgtgcctgttcccaggagggcgtcgtggactgtggcggtattgacctgcgtgagttcccgggggacctgcctgagcacaccaaccacctatctctgcagaacaacaagctggagaagatccccccgggggccttcagcgagctgagcagcctgcgcgagctatacctgcagaacaactacctgactgacgagggcctggacaacgagaccttctggaagctctccagcctggagtacctggatctgtccagcaacaacctgtctcgggtcccagctgggctgccgcgcagcctggtgctgctgcacttggagaagaacgccatccggagcgtggacgcgaatgtgctgacccccatccgcagcctggagtacctgctgctgcacagcaaccagctgcgggagcagggcatccacccactggccttccagggcctcaagcggttgcacacggtgcacctgtacaacaacgcgctggagcgcgtgcccagtggcctgcctcgccgcgtgcgcaccctcatgatcctgcacaaccagatcacaggcattggccgcgaagactttgccaccacctacttcctggaggagctcaacctcagctacaaccgcatcaccagcccgcaggtgcaccgcgacgccttccgcaagctgcgcctgctgcgctcgctggacctgtcgggcaaccggctgcacacgctgccacctgggctgcctcgaaatgtccatgtgctgaaggtcaagcgcaatgagctggctgccttggcacgaggggcgctggtgggcatggctcagctgcgtgagctgtacctcaccagcaaccgactgcgcagccgagccctgggcccccgtgcctgggtggacctcgcccatctgcagctgctggacatcgccgggaatcagctcacagagatccccgaggggctccccgagtcacttgagtacctgtacctgcagaacaacaagattagtgcggtgcccgccaatgccttcgactccacgcccaacctcaaggggatctttctcaggtttaacaagctggctgtgggctccgtggtggacagtgccttccggaggctgaagcacctgcaggtcttggacattgaaggcaacttagagtttggtgacatttccaaggaccgtggccgcttggggaaggaaaaggaggaggaggaagaggaggaggaggaggaagaggaaacaagatagtgacaaggtgatgcagatgtgacctaggacgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgc

SEQ ID NO: 166857 - DNA, 3065 bp, Homo sapiens
  Payload ID: 12849
  Gene Symbol: PODN
  Gene Name: podocan
  Uniprot ID: Q7Z5L7
  ENST ID: ENST00000618387
  CDS Start-End: 121-2049
gacttgaatggaaggagcccgagcccgcggagcgcagctgagactgggggagcgcgttcggcctgtggggcgccgctcggcgccggggcgcagcagtttacagatttttacagataccaaatggaaggcgaggaggcagaacagcctgcctggttccgtcagccctggcgcccaggcgcatctgactcggcaccccctgcaggcaccatggcccagagccgggtgctgctgctcctgctgctgctgccgccacagctgcacctgggacctgtgcttgccgtgagggccccaggatttggccgaagtggcggccacagcctgagccccgaagagaacgaatttgcggaggaggagccggtgctggtactgagccctgaggagcccgggcctggcccagccgcggtcagctgcccccgagactgtgcctgttcccaggagggcgtcgtggactgtggcggtattgacctgcgtgagttcccgggggacctgcctgagcacaccaaccacctatctctgcagaacaaccagctggaaaagatctaccctgaggagctctcccggctgcaccggctggagacgctgaacctgcaaaacaaccgcctgacttcccgagggctcccagagaaggcgtttgagcatctgaccaacctcaattacctgtacttggccaataacaagctgaccttggcaccccgcttcctgccaaacgccctgatcagtgtggactttgctgccaactatctcaccaagatctatgggctcacctttggccagaagccaaacttgaggtctgtgtacctgcacaacaacaagctggcagacgccgggctgccggacaacatgttcaacggctccagcaacgtcgaggtcctcatcctgtccagcaacttcctgcgccacgtgcccaagcacctgccgcctgccctgtacaagctgcacctcaagaacaacaagctggagaagatccccccgggggccttcagcgagctgagcagcctgcgcgagctatacctgcagaacaactacctgactgacgagggcctggacaacgagaccttctggaagctctccagcctggagtacctggatctgtccagcaacaacctgtctcgggtcccagctgggctgccgcgcagcctggtgctgctgcacttggagaagaacgccatccggagcgtggacgcgaatgtgctgacccccatccgcagcctggagtacctgctgctgcacagcaaccagctgcgggagcagggcatccacccactggccttccagggcctcaagcggttgcacacggtgcacctgtacaacaacgcgctggagcgcgtgcccagtggcctgcctcgccgcgtgcgcaccctcatgatcctgcacaaccagatcacaggcattggccgcgaagactttgccaccacctacttcctggaggagctcaacctcagctacaaccgcatcaccagcccgcaggtgcaccgcgacgccttccgcaagctgcgcctgctgcgctcgctggacctgtcgggcaaccggctgcacacgctgccacctgggctgcctcgaaatgtccatgtgctgaaggtcaagcgcaatgagctggctgccttggcacgaggggcgctggtgggcatggctcagctgcgtgagctgtacctcaccagcaaccgactgcgcagccgagccctgggcccccgtgcctgggtggacctcgcccatctgcagctgctggacatcgccgggaatcagctcacagagatccccgaggggctccccgagtcacttgagtacctgtacctgcagaacaacaagattagtgcggtgcccgccaatgccttcgactccacgcccaacctcaaggggatctttctcaggtttaacaagctggctgtgggctccgtggtggacagtgccttccggaggctgaagcacctgcaggtcttggacattgaaggcaacttagagtttggtgacatttccaaggaccgtggccgcttggggaaggaaaaggaggaggaggaagaggaggaggaggaggaagaggaaacaagatagtgacaaggtgatgcagatgtgacctaggacgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgc

SEQ ID NO: 166858 - DNA, 1859 bp, Homo sapiens
  Payload ID: 12850
  Gene Symbol: PODNL1
  Gene Name: podocan-like 1
  ENST ID: ENST00000254320
  CDS Start-End: 217-1509
agtcaccatggcgaccctgcgcccagcctggagacacgctgaccctccctcccccgcagtggccgagcctgctgctgctcctgctgttgccggggcccccgcccgtcgccggcttggaagacgctgccttcccccacctgggggagagcttgcagcccctgccccgggcctgtcccctgcgctgctcctgcccccgagtcgacactgtggactgtgatggcttggaccttcgagtgttcccggacaacatcaccagagccgctcagcacctctccctgcagaacaaccagctccaggaactcccctacaatgagctgtcccgcctcagtggcctgcgaaccctcaacctccacaacaacctcatctcctccgaagctctcagtggcccctcagtttctgccccggtccctccgtgtcgcggatctggctgccaaccaagtgatggagatcttccccctcacctttggggagaagccggcactcaggtccgtgtacctccacaacaaccagctgagcaacgctggcctgccccccgacgccttccgcggctccgaggccatcgccaccctcagcctctccaacaaccagctcagctacctgccgcccagcctgccgccctcactcgagcggctccacctgcagaacaatctcatctccaaggtgccccgaggagccctgagccgccagactcaactccgtgagctctacctccagcacaaccagctgacagacagtggcctggatgccaccaccttcagcaagctgcatagccttgaatacctggatctctcccacaaccagctgaccacagtgcccgccggcctgccccggaccctggctatcctgcacctgggccgcaaccgcatccggcaggtggaggcggctcggctgcacggggcgcgtggtctgcgctatttgttgctgcagcacaaccagctggggagctcagggctgcccgccggggctctgcggccgctgcggggcctgcacacgctgcacctctatggcaatgggctggaccgcgtgcctccagccctgccccgccgcctgcgtgccctggtgctgccccacaaccacgtggccgcgctgggtgcccgtgacctggtcgccacaccgggcctgacggagcttaacctggcctataaccgcctggccagcgcccgtgtgcaccaccgggccttccgccggttgcgtgccctgcgcagcctcgacctggcagggaatcagctaacccggctgcccatgggcctgcccactggcctgcgcaccctgcagctgcaacgcaaccagctgcggatgctcgagcccgagcctctggccggcctggaccaactgcgggagctcagcctggcgcacaaccggctccgggtcggcgacatcgggccaggcacctggcatgagctccaagccctccaggtcaggcacaggctggttagccacactgtccccagggcccctccatccccctgcctgccctgccacgtcccaaacattctagttagctggtaaagcaatcagaacaagaaaatgataagagtgggttagaaggtgatgaggaggctgggtgaggtggctcatgcctgtaatcccagcactttggggagccaaggcaggagaatcgctttaggctatgggtttgagaccagcctggcaacacagcaagaccctatctctaccaaaaaaacatagccaagcgtggtggcacatgcctgtagtcccagctattcaggaggctgaggcaggaggatcgcttgagcccagaagtttgaggctgcaatgagccgtgatcgggccactgccctctagactgggcaacagagcaagaccctgtctcttgaaaaaaaaagtgatgaaagagg

SEQ ID NO: 166859 - DNA, 2165 bp, Homo sapiens
  Payload ID: 12850
  Gene Symbol: PODNL1
  Gene Name: podocan-like 1
  Uniprot ID: Q6PEZ8
  ENST ID: ENST00000339560
  CDS Start-End: 275-1813
aggctggctgaggttacgaaagcagagatggggtggttgttgggggggaccaaggggacgggctggcctgtcctcaccaccccatccggccgcctgcccgtcctccccagggcggggaagggggtgggccagctcccccaaagccccgggagaacaggctgttgtggggggtggcatgggtctggagatggggggcggtggtggccacagcagaggctccaggaggtgaccgcctggtttccattaggaagtcctggtcagcagcttgggcgagatggcagagtcagggctggccatgtggccgagcctgctgctgctcctgctgttgccggggcccccgcccgtcgccggcttggaagacgctgccttcccccacctgggggagagcttgcagcccctgccccgggcctgtcccctgcgctgctcctgcccccgagtcgacactgtggactgtgatggcttggaccttcgagtgttcccggacaacatcaccagagccgctcagcacctctccctgcagaacaaccagctccaggaactcccctacaatgagctgtcccgcctcagtggcctgcgaaccctcaacctccacaacaacctcatctcctccgaaggcctgcctgacgaggccttcgagtccctcacccagctgcagcacctctgcgtggctcacaacaagctctcagtggcccctcagtttctgccccggtccctccgtgtcgcggatctggctgccaaccaagtgatggagatcttccccctcacctttggggagaagccggcactcaggtccgtgtacctccacaacaaccagctgagcaacgctggcctgccccccgacgccttccgcggctccgaggccatcgccaccctcagcctctccaacaaccagctcagctacctgccgcccagcctgccgccctcactcgagcggctccacctgcagaacaatctcatctccaaggtgccccgaggagccctgagccgccagactcaactccgtgagctctacctccagcacaaccagctgacagacagtggcctggatgccaccaccttcagcaagctgcatagccttgaatacctggatctctcccacaaccagctgaccacagtgcccgccggcctgccccggaccctggctatcctgcacctgggccgcaaccgcatccggcaggtggaggcggctcggctgcacggggcgcgtggtctgcgctatttgttgctgcagcacaaccagctggggagctcagggctgcccgccggggctctgcggccgctgcggggcctgcacacgctgcacctctatggcaatgggctggaccgcgtgcctccagccctgccccgccgcctgcgtgccctggtgctgccccacaaccacgtggccgcgctgggtgcccgtgacctggtcgccacaccgggcctgacggagcttaacctggcctataaccgcctggccagcgcccgtgtgcaccaccgggccttccgccggttgcgtgccctgcgcagcctcgacctggcagggaatcagctaacccggctgcccatgggcctgcccactggcctgcgcaccctgcagctgcaacgcaaccagctgcggatgctcgagcccgagcctctggccggcctggaccaactgcgggagctcagcctggcgcacaaccggctccgggtcggcgacatcgggccaggcacctggcatgagctccaagccctccaggtcaggcacaggctggttagccacactgtccccagggcccctccatccccctgcctgccctgccacgtcccaaacattctagttagctggtaaagcaatcagaacaagaaaatgataagagtgggttagaaggtgatgaggaggctgggtgaggtggctcatgcctgtaatcccagcactttggggagccaaggcaggagaatcgctttaggctatgggtttgagaccagcctggcaacacagcaagaccctatctctaccaaaaaaacatagccaagcgtggtggcacatgcctgtagtcccagctattcaggaggctgaggcaggaggatcgcttgagcccagaagtttgaggctgcaatgagccgtgatcgggccactgccctctagactgggcaacagagcaagaccctgtctcttgaaaaaaaaagtgatgaaagaggta

SEQ ID NO: 166860 - DNA, 2744 bp, Homo sapiens
  Payload ID: 12850
  Gene Symbol: PODNL1
  Gene Name: podocan-like 1
  Uniprot ID: Q6PEZ8
  ENST ID: ENST00000538517
  CDS Start-End: 246-1511
aaagctaccagcctcacggagaaggcgcagtccctgtccacagagacacagccttgccccagttactgcccacctgcaagagatccacatttctgccctccagagctcccaaactgatgggggagagagacatcatcccccagctctgggagtttccagtctgatggaggagacagagcctgcttcggtaactctcactctgcgggggaagactcagccctatccagggagctcccacactttcaatggggaggcccacccagtggccgagcctgctgctgctcctgctgttgccggggcccccgcccgtcgccggcttggaagacgctgccttcccccacctgggggagagcttgcagcccctgccccgggcctgtcccctgcgctgctcctgcccccgagtcgacactgtggactgtgatggcttggaccttcgagtgttcccggacaacatcaccagagccgctcagcacctctccctgcagaacaaccagctccaggaactcccctacaatgagctgtcccgcctcagtggcctgcgaaccctcaacctccacaacaacctcatctcctccgaaggcctgcctgacgaggccttcgagtccctcacccagctgcagcacctctgcgtggctcacaacaagaacaatctcatctccaaggtgccccgaggagccctgagccgccagactcaactccgtgagctctacctccagcacaaccagctgacagacagtggcctggatgccaccaccttcagcaagctgcatagccttgaatacctggatctctcccacaaccagctgaccacagtgcccgccggcctgccccggaccctggctatcctgcacctgggccgcaaccgcatccggcaggtggaggcggctcggctgcacggggcgcgtggtctgcgctatttgttgctgcagcacaaccagctggggagctcagggctgcccgccggggctctgcggccgctgcggggcctgcacacgctgcacctctatggcaatgggctggaccgcgtgcctccagccctgccccgccgcctgcgtgccctggtgctgccccacaaccacgtggccgcgctgggtgcccgtgacctggtcgccacaccgggcctgacggagcttaacctggcctataaccgcctggccagcgcccgtgtgcaccaccgggccttccgccggttgcgtgccctgcgcagcctcgacctggcagggaatcagctaacccggctgcccatgggcctgcccactggcctgcgcaccctgcagctgcaacgcaaccagctgcggatgctcgagcccgagcctctggccggcctggaccaactgcgggagctcagcctggcgcacaaccggctccgggtcggcgacatcgggccaggcacctggcatgagctccaagccctccaggtcaggcacaggctggttagccacactgtccccagggcccctccatccccctgcctgccctgccacgtcccaaacattctagttagctggtaaagcaatcagaacaagaaaatgataagagtgggttagaaggtgatgaggaggctgggtgaggtggctcatgcctgtaatcccagcactttggggagccaaggcaggagaatcgctttaggctatgggtttgagaccagcctggcaacacagcaagaccctatctctaccaaaaaaacatagccaagcgtggtggcacatgcctgtagtcccagctattcaggaggctgaggcaggaggatcgcttgagcccagaagtttgaggctgcaatgagccgtgatcgggccactgccctctagactgggcaacagagcaagaccctgtctcttgaaaaaaaaagtgatgaaagaggtatggtgcgattcaatgactgactcatttaatcaagtggggacctgtctgtctgtgccttcctgggaagggccttagtttacctctgcagaagggaggaatttggcaatcatggggggtggggggcagaagggccaggctggtatgaagggggcaggggactctcagagaggttgggggctggctgagctgagtggcccaggcctggggctgccacgatgccatctataaccccctgcccagatgctggacctcagccacaatgagctgtcctttgtgcccccggacctgcctgaggccctagaggagctgcacctcgagggcaaccgcatcggccacgtgggccccgaggccttcctcagcacaccccgcctgcgtgccctcttcctcaggtgccccgagggtgaccggaggggtggaggtgggcaggggagggcctgggagggtcatgaccgcctctctgtgcagggccaacaggcttcacatgacgagcatcgcggctgaggccttcctggggctcccaaacctgcgtgtggtggacacggcagggaatccggagcaggtcctgatccggctgcctcccaccaccccacgtgggccacgggcagggggcccctgatcctagagaggcccagcagagcagctcagactcctgggactccgctgggccgtggactgaggagacaacgcccaccaggggcccttggtctggctctcctgggcctccagggctgggcctgctctgcctgccactggccgagacacagaggcacacagctggcatactccaggctcacagaccacgccggcctggcgggacacaccctaccccaaactcccaacacagatggaggcagcaacaataaagccaaacccttccagca

SEQ ID NO: 166861 - DNA, 1826 bp, Homo sapiens
  Payload ID: 12850
  Gene Symbol: PODNL1
  Gene Name: podocan-like 1
  Uniprot ID: Q6PEZ8
  ENST ID: ENST00000538371
  CDS Start-End: 257-1789
actgcccttacaaagctaccagcctcacggagaaggcgcagtccctgtccacagagacacagccttgccccagttactgcccacctgcaagagatccacatttctgccctccagagctcccaaactgatgggggagagagacatcatcccccagctctgggagtttccagtctgatggaggagacagagcctgcttcggtaactctcactctgcgggggaagactcagccctatccagggagctcccacactttcaatggggaggcccacccagtggccgagcctgctgctgctcctgctgttgccggggcccccgcccgtcgccggcttggaagacgctgccttcccccacctgggggagagcttgcagcccctgccccgggcctgtcccctgcgctgctcctgcccccgagtcgacactgtggactgtgatggcttggaccttcgagtgttcccggacaacatcaccagagccgctcagcacctctccctgcagaacaaccagctccaggaactcccctacaatgagctgtcccgcctcagtggcctgcgaaccctcaacctccacaacaacctcatctcctccgaaggcctgcctgacgaggccttcgagtccctcacccagctgcagcacctctgcgtggctcacaacaagctctcagtggcccctcagtttctgccccggtccctccgtgtcgcggatctggctgccaaccaagtgatggagatcttccccctcacctttggggagaagccggcactcaggtccgtgtacctccacaacaaccagctgagcaacgctggcctgccccccgacgccttccgcggctccgaggccatcgccaccctcagcctctccaacaaccagctcagctacctgccgcccagcctgccgccctcactcgagcggctccacctgcagaacaatctcatctccaaggtgccccgaggagccctgagccgccagactcaactccgtgagctctacctccagcacaaccagctgacagacagtggcctggatgccaccaccttcagcaagctgcatagccttgaatacctggatctctcccacaaccagctgaccacagtgcccgccggcctgccccggaccctggctatcctgcacctgggccgcaaccgcatccggcaggtggaggcggctcggctgcacggggcgcgtggtctgcgctatttgttgctgcagcacaaccagctggggagctcagggctgcccgccggggctctgcggccgctgcggggcctgcacacgctgcacctctatggcaatgggctggaccgcgtgcctccagccctgccccgccgcctgcgtgccctggtgctgccccacaaccacgtggccgcgctgggtgcccgtgacctggtcgccacaccgggcctgacggagcttaacctggcctataaccgcctggccagcgcccgtgtgcaccaccgggccttccgccggttgcgtgccctgcgcagcctcgacctggcagggaatcagctaacccggctgcccatgggcctgcccactggcctgcgcaccctgcagctgcaacgcaaccagctgcggatgctcgagcccgagcctctggccggcctggaccaactgcgggagctcagcctggcgcacaaccggctccgggtcggcgacatcgggccaggcacctggcatgagctccaagccctccaggtcaggcacaggctggttagccacactgtccccagggcccctccatccccctgcctgccctgccacgtcccaaacattctagttagctggtaaagcaatcagaacaagaaaatgataagagtgggttaga

SEQ ID NO: 166862 - DNA, 545 bp, Homo sapiens
  Payload ID: 12850
  Gene Symbol: PODNL1
  Gene Name: podocan-like 1
  ENST ID: ENST00000588764
  CDS Start-End: 1-545
ccttcgagtccctcacccagctgcagcacctctgcgtggctcacaacaagctgagcaacgctggcctgccccccgacgccttccgcggctccgaggccatcgccaccctcagcctctccaacaaccagctcagctacctgccgcccagcctgccgccctcactcgagcggctccacctgcagaacaatctcatctccaaggtgccccgaggagccctgagccgccagactcaactccgtgagctctacctccagcacaaccagctgacagacagtggcctggatgccaccaccttcagcaagctgcatagccttgaatacctggatctctcccacaaccagctgaccacagtgcccgccggcctgccccggaccctggctatcctgcacctgggccgcaaccgcatccggcaggtggaggcggctcggctgcacggggcgcgtggtctgcgctatttgttgctgcagcacaaccagctggggagctcagggctgcccgccggggctctgcggccgctgcggggcctgcacacgctgcacctctat

SEQ ID NO: 166863 - DNA, 537 bp, Homo sapiens
  Payload ID: 12850
  Gene Symbol: PODNL1
  Gene Name: podocan-like 1
  ENST ID: ENST00000585607
  CDS Start-End: 167-537
gagatccacatttctgccctccagagctcccaaactgatgggggagagagacatcatcccccagctctgggagtttccagtctgatggaggagacagagcctgcttcggtaactctcactctgcgggggaagactcagccctatccagggagctcccacactttcaatggggaggcccacccagtggccgagcctgctgctgctcctgctgttgccggggcccccgcccgtcgccggcttggaagacgctgccttcccccacctgggggagagcttgcagcccctgccccgggcctgtcccctgcgctgctcctgcccccgagtcgacactgtggactgtgatggcttggaccttcgagtgttcccggacaacatcaccagagccgctcagcacctctccctgcagaacaaccagctccaggaactcccctacaatgagctgtcccgcctcagtggcctgcgaaccctcaacctccacaacaacctcatctcctccgaagaacaatctcatctccaaggtgccccgaggagccctga

SEQ ID NO: 166864 - DNA, 992 bp, Homo sapiens
  Payload ID: 12850
  Gene Symbol: PODNL1
  Gene Name: podocan-like 1
  ENST ID: ENST00000588872
  CDS Start-End: 1-716
tctatggcaatgggctggaccgcgtgcctccagccctgccccgccgcctgcgtgccctggtgctgccccacaaccacgtggccgcgctgggtgcccgtgacctggtcgccacaccgggcctgacggagcttaacctggcctataaccgcctggccagcgcccgtgtgcaccaccgggccttccgccggttgcgtgccctgcgcagcctcgacctggcagggaatcagctaacccggctgcccatgggcctgcccactggcctgcgcaccctgcagctgcaacgcaaccagctgcggatgctcgagcccgagcctctggccggcctggaccaactgcgggagctcagcctggcgcacaaccggctccgggtcggcgacatcgggccaggcacctggcatgagctccaagccctccagatgctggacctcagccacaatgagctgtcctttgtgcccccggacctgcctgaggccctagaggagctgcacctcgagggcaaccgcatcggccacgtgggccccgaggccttcctcagcacaccccgcctgcgtgccctcttcctcagggccaacaggcttcacatgacgagcatcgcggctgaggccttcctggggctcccaaacctgcgtgtggtggacacggcagggaatccggagcaggtcctgatccggctgcctcccaccaccccacgtgggccacgggcagggggcccctgatcctagagaggcccagcagagcagctcagactcctgggactccgctgggccgtggactgaggagacaacgcccaccaggggcccttggtctggctctcctgggcctccagggctgggcctgctctgcctgccactggccgagacacagaggcacacagctggcatactccaggctcacagaccacgccggcctggcgggacacaccctaccccaaactcccaacacagatggaggcagcaacaataaagccaaacccttccagcactcagcacgga

SEQ ID NO: 166865 - DNA, 562 bp, Homo sapiens
  Payload ID: 12850
  Gene Symbol: PODNL1
  Gene Name: podocan-like 1
  ENST ID: ENST00000587458
  CDS Start-End: 466-562
acaaagctaccagcctcacggagaaggcgcagtccctgtccacagagacacagccttgccccagttactgcccacctgcaagagatccacatttctgccctccagagctcccaaactgatgggggagagagacatcatcccccagctctgggagtttccagtctgatggaggagacagagcctgcttcgagtggcgtgcagtggcacatagctcattgtaacctcaaacttgagcccagaggctcaagtgttcctcctgccttggcctcctgagtacctgggactgtgggtgtgcaccaccataccagtggccgagcctgctgctgctcctgctgttgccggggcccccgcccgtcgccggcttggaagacgctgccttcccccacctgggggagagcttgcagcccctgccccgggcctgtcccctgcgctgctcctgcccccgagtcgacactgtggactgtgatggcttggaccttcgagtgttcccggacaacatcaccagagccgctcagcacctctccctgcagaacaaccagctccaggaactcccctacaatga

SEQ ID NO: 166866 - DNA, 739 bp, Homo sapiens
  Payload ID: 12850
  Gene Symbol: PODNL1
  Gene Name: podocan-like 1
  ENST ID: ENST00000586075
  CDS Start-End: 248-739
accaagaccctccccgaggaggggatgctccagtcaccatggcgaccctgcgcccagcctggagacacgctgaccctccctcccccgcagtggccgagcctgctgctgctcctgctgttgccggggcccccgcccgtcgccggcttggaagacgctgccttcccccacctgggggagagcttgcagcccctgccccgggcctgtcccctgcgctgctcctgcccccgagtcgacactgtggactgtgatggcttggaccttcgagtgttcccggacaacatcaccagagccgctcagcacctctccctgcagaacaaccagctccaggaactcccctacaatgagctgtcccgcctcagtggcctgcgaaccctcaacctccacaacaacctcatctcctccgaagaacaatctcatctccaaggtgccccgaggagccctgagccgccagactcaactccgtgagctctacctccagcacaaccagctgacagacagtggcctggatgccaccaccttcagcaagctgcatagccttgaatacctggatctctcccacaaccagctgaccacagtgcccgccggcctgccccggaccctggctatcctgcacctgggccgcaaccgcatccggcaggtggaggcggctcggctgcacggggcgcgtggtctgcgctatttgttgctgcagcacaaccagctggggagctcagggctgcccgccggggctctgcggccg

SEQ ID NO: 166867 - DNA, 454 bp, Homo sapiens
  Payload ID: 12850
  Gene Symbol: PODNL1
  Gene Name: podocan-like 1
  ENST ID: ENST00000591353
  CDS Start-End: 1-454
cgacgccttccgcggctccgaggccatcgccaccctcagcctctccaacaaccagctcagctacctgccgcccagcctgccgccctcactcgagcggctccacctgcaggtagccctgctaacaatctcatctccaaggtgccccgaggagccctgagccgccagactcaactccgtgagctctacctccagcacaaccagctgacagacagtggcctggatgccaccaccttcagcaagctgcatagccttgaatacctggatctctcccacaaccagctgaccacagtgcccgccggcctgccccggaccctggctatcctgcacctgggccgcaaccgcatccggcaggtggaggcggctcggctgcacggggcgcgtggtctgcgctatttgttgctgcagcacaaccagctggggagctcagggctgcccgccggggctctgcggccgc

SEQ ID NO: 166868 - DNA, 1073 bp, Homo sapiens
  Payload ID: 12850
  Gene Symbol: PODNL1
  Gene Name: podocan-like 1
  ENST ID: ENST00000587954
  CDS Start-End: 1-408
ctgcagctgcaacgcaaccagctgcggatgctcgagcccgagcctctggccggcctggaccaactgcgggagctcagcctggcgcacaaccggctccgggtcggcgacatcgggccaggcacctggcatgagctccaagccctccagatgctggacctcagccacaatgagctgtcctttgtgcccccggacctgcctgaggccctagaggagctgcacctcgagggcaaccgcatcggccacgtgggccccgaggccttcctcagcacaccccgcctgcgtgccctcttcctcaggtgccccgagggtgaccggaggggtggaggtgggcaggggagggcctgggagggtcatgaccgcctctctgtgcagggccaacaggcttcacatgacgagcatcgcggctgaggccttcctggggctcccaaacctgcgtgtggtggacacggcagggaatccggagcaggtcctgatccggctgcctcccaccaccccacgtgggccacgggcagggggcccctgatcctagagaggcccagcagagcagctcagactcctgggactccgctgggccgtggactgaggagacaacgcccaccaggggcccttggtctggctctcctgggcctccagggctgggcctgctctgcctgccactggccgagacacagaggcacacagctggcatactccaggctcacagaccacgccggcctggcgggacacaccctaccccaaactcccaacacagatggaggcagcaacaataaagccaaacccttccagcactcagcacggaccaggcaccctttgggggctctgtccacggactcctccccacaaccagtccagctggggaaactgaggctctgggatgctaagtgggtcaggactgaattttgaggtcttgaggcacacactggggtcaccaaacagcaccctgtgcgacctagccacgtgtgattgcagggacgcccaaggccacccactgaaaaaacactgggtgacagatatagggaccctcacatgtatccccccccacagcaagcatgggaatgaaatgcatccttcaa

SEQ ID NO: 166869 - DNA, 3104 bp, Homo sapiens
  Payload ID: 12851
  Gene Symbol: PDPN
  Gene Name: podoplanin
  Uniprot ID: Q86YL7
  ENST ID: ENST00000294489
  CDS Start-End: 342-1058
acttctcacttctgcccataacaagaaaaacatagacttgtgccttactcttaaaaaaataataataataaatataggttttttaaaatttatatataatttttaaaaccccgtttgttgcatgtggtccctttccctcctgttgttgagcagaataaaagcccattttgccagggcccgcagtcctggcggcccccgcagctgcggccctgtaactttaaacctggcctgagatcatcgttttggcgccggccaaacagagcccgagggcgggcctagcgcgcccggacggagaccaccttgcggccgaccccgctcccccgcctcctcgggagagataaatgctgactccgctcggaaagttctcaactgcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctggatgccgaggaagctgctggatgcttaatggtgctagaggctcaagtgtgtttgaaaccaagagccagttgtcccccatgcagaaagaaatcctgtgtgagcctctggtatgagaaataaaatctgccagttttataacattcactttctgcctctgaggaaagatacagggaacaaaaatcaatttgtacagtcttaatattaaaagcagcttgactaaatacctgatttaaaaatagaagacatccccagtcctcatgacataccgcaaatatctgtggggtcctgttgaaaagaacaaaataaaggagcccaaggggtcattctgtctcagcaccatccagcctggcacttctcttcccatatatccattggatttttttttttttttcctaaacaaagtttttacactgagcagatgctctgtcatgatggcggttgtgcaattctggtatcctctaaatttgtaagcattcataaaacaggaaaaagtaaactatcattcggaagcacagcccattcctcccattttttgcaatgatgtctggatgttattttaaacagtgtgtctgtgtgttcccaaatccagctggccccaccagctcagattccattttttttgtgtgtgtgtgtgaaacgtagtctgcaactctgcctcccggcaattatacatgtgtcaggatgtcaaaaagcaattctcctgcctcagcctcctgagtagctgggactacaggttcctaccaccacacccggccaatttttgtatttttagtagagatggggtttcaccgtatcggcgaggatgatctctatctcttgacctcgtgatctgcccgcctcggcctcccaaagtgctgggattacaggcgtgtgccactgcgctcggcctcagattccatatttgaacaccagctgattgagagaaggggaatgagaagagctggatgagtttaaataactcattgttcagattcctgaacaggagttgggataatggccatcttttctttcctatcctttcttcccccctcactgtgaaaaataacagtccaccccaagtcatacactggacccagtgcctgcggggacaggactgtgggtttcttggtcacacctgtgttggtgctcaatgcagtgtagacatgttttcaaataaaacaaatgattgtgtacaa

SEQ ID NO: 166870 - DNA, 2801 bp, Homo sapiens
  Payload ID: 12851
  Gene Symbol: PDPN
  Gene Name: podoplanin
  Uniprot ID: Q86YL7
  ENST ID: ENST00000376057
  CDS Start-End: 45-755
accttgcggccgaccccgctcccccgcctcctcgggagagataaatgctgactccgctcggaaagttctcaactgcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctggatgccgaggaagctgctggatgcttaatggtgctagaggctcaagtgtgtttgaaaccaagagccagttgtcccccatgcagaaagaaatcctgtgtgagcctctggtatgagaaataaaatctgccagttttataacattcactttctgcctctgaggaaagatacagggaacaaaaatcaatttgtacagtcttaatattaaaagcagcttgactaaatacctgatttaaaaatagaagacatccccagtcctcatgacataccgcaaatatctgtggggtcctgttgaaaagaacaaaataaaggagcccaaggggtcattctgtctcagcaccatccagcctggcacttctcttcccatatatccattggatttttttttttttttcctaaacaaagtttttacactgagcagatgctctgtcatgatggcggttgtgcaattctggtatcctctaaatttgtaagcattcataaaacaggaaaaagtaaactatcattcggaagcacagcccattcctcccattttttgcaatgatgtctggatgttattttaaacagtgtgtctgtgtgttcccaaatccagctggccccaccagctcagattccattttttttgtgtgtgtgtgtgaaacgtagtctgcaactctgcctcccggcaattatacatgtgtcaggatgtcaaaaagcaattctcctgcctcagcctcctgagtagctgggactacaggttcctaccaccacacccggccaatttttgtatttttagtagagatggggtttcaccgtatcggcgaggatgatctctatctcttgacctcgtgatctgcccgcctcggcctcccaaagtgctgggattacaggcgtgtgccactgcgctcggcctcagattccatatttgaacaccagctgattgagagaaggggaatgagaagagctggatgagtttaaataactcattgttcagattcctgaacaggagttgggataatggccatcttttctttcctatcctttcttcccccctcactgtgaaaaataacagtccaccccaagtcatacactggacccagtgcctgcggggacaggactgtgggtttcttggtcacacctgtgttggtgctcaatgcagtgtagacatgttttcaaataaaacaaatgattgtgtacaa

SEQ ID NO: 166871 - DNA, 1368 bp, Homo sapiens
  Payload ID: 12851
  Gene Symbol: PDPN
  Gene Name: podoplanin
  Uniprot ID: Q86YL7
  ENST ID: ENST00000376061
  CDS Start-End: 135-497
ttagtcggtgccaggtcccaaagacgcagctgcgcgggtgtgccgggaggagccccggaatccacaggctgcgagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctg

SEQ ID NO: 166872 - DNA, 476 bp, Homo sapiens
  Payload ID: 12851
  Gene Symbol: PDPN
  Gene Name: podoplanin
  ENST ID: ENST00000506205
  CDS Start-End: 1-283
aactgcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggaggggaaggcgtttaacaactcgggggtgaagcctggtggacagcggcagggacatcataaatacagaagataattttaaagaagtgttccggccgggtgcagtggctcacaactgtaatcccaggactttgggaggctgaggcgggcagatcacctgagccagcacaggccagccagaagatgacactgagactacaggtttggaagg

SEQ ID NO: 166873 - DNA, 571 bp, Homo sapiens
  Payload ID: 12851
  Gene Symbol: PDPN
  Gene Name: podoplanin
  ENST ID: ENST00000509009
  CDS Start-End: 45-518
agaaggaggtaagacccagcgcaagtggcttcctgccgtcgctgatggggacgagcgagcagagacttgctggaatgcccgggcctggtattcgagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgccctaaagagctgaagggttacgccctgctgccaacgtgcttaaaaaaagaccgtttct

SEQ ID NO: 166874 - DNA, 1305 bp, Homo sapiens
  Payload ID: 12851
  Gene Symbol: PDPN
  Gene Name: podoplanin
  Uniprot ID: Q86YL7
  ENST ID: ENST00000513143
  CDS Start-End: 290-652
gtcggtgccaggtcccaaagacgcagctgcgcgggtgtgccgggaggagccccggaatccacaggctgcgaggggaaggcgtttaacaactcgggggtgaagcctggtggacagcggcagggacatcataaatacagaagataattttaaagaagtgttccggccgggtgcagtggctcacaactgtaatcccaggactttgggaggctgaggcgggcagatcacctgagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcact

SEQ ID NO: 166875 - DNA, 849 bp, Homo sapiens
  Payload ID: 12851
  Gene Symbol: PDPN
  Gene Name: podoplanin
  Uniprot ID: Q86YL7
  ENST ID: ENST00000475043
  CDS Start-End: 157-513
gacaatgtgcaaatgacaccgttttgtgctcaccagggcaaagcaagggagcgccctcacttcagcatctcagccctgctaaagaaaaagctgctggccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaacc

SEQ ID NO: 166876 - DNA, 794 bp, Homo sapiens
  Payload ID: 12851
  Gene Symbol: PDPN
  Gene Name: podoplanin
  ENST ID: ENST00000488631
  CDS Start-End: 220-351
gcaaatgacaccgttttgtgctcaccagggcaaagcaagggagcgccctcacttcagcatctcagccctgctaaagaaaaagctgctgggtaacatcctttgtttttgcccagggaagctttagctgtgattcccttcagccggctcctgaatgtcaaagccagcacaggccagccagaagatgacactgagactacaggtttggaaggcggcgttgccatgccaggtgccgaagatgatgtggtgactccaggaaccagcgaagaccgctataagtctggcttgacaactctgagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgt

SEQ ID NO: 166877 - DNA, 786 bp, Homo sapiens
  Payload ID: 12851
  Gene Symbol: PDPN
  Gene Name: podoplanin
  ENST ID: ENST00000510906
  CDS Start-End: 202-687
actgcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgtaagtaaatagcttacacccatgtgataggcaaatgaaagccatcgtgtctagaactcaaatctttgaactaatagaaatctctgatataagctgggtgtgg

SEQ ID NO: 166878 - DNA, 607 bp, Homo sapiens
  Payload ID: 12851
  Gene Symbol: PDPN
  Gene Name: podoplanin
  Uniprot ID: Q86YL7
  ENST ID: ENST00000487038
  CDS Start-End: 239-601
ctttttggcgagacaatgtgcaaatgacaccgttttgtgctcaccagggcaaagcaagggagcgccctcacttcagcatctcagccctgctaaagaaaaagctgctgggtaacatcctttgtttttgcccagggaagctttagctgtgattcccttcagccggctcctgaatgtcaaagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgccctaaagagct

SEQ ID NO: 166879 - DNA, 2738 bp, Homo sapiens
  Payload ID: 12851
  Gene Symbol: PDPN
  Gene Name: podoplanin
  Uniprot ID: Q86YL7
  ENST ID: ENST00000621990
  CDS Start-End: 204-692
caactgcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctggatgccgaggaagctgctggatgcttaatggtgctagaggctcaagtgtgtttgaaaccaagagccagttgtcccccatgcagaaagaaatcctgtgtgagcctctggtatgagaaataaaatctgccagttttataacattcactttctgcctctgaggaaagatacagggaacaaaaatcaatttgtacagtcttaatattaaaagcagcttgactaaatacctgatttaaaaatagaagacatccccagtcctcatgacataccgcaaatatctgtggggtcctgttgaaaagaacaaaataaaggagcccaaggggtcattctgtctcagcaccatccagcctggcacttctcttcccatatatccattggatttttttttttttttcctaaacaaagtttttacactgagcagatgctctgtcatgatggcggttgtgcaattctggtatcctctaaatttgtaagcattcataaaacaggaaaaagtaaactatcattcggaagcacagcccattcctcccattttttgcaatgatgtctggatgttattttaaacagtgtgtctgtgtgttcccaaatccagctggccccaccagctcagattccattttttttgtgtgtgtgtgtgaaacgtagtctgcaactctgcctcccggcaattatacatgtgtcaggatgtcaaaaagcaattctcctgcctcagcctcctgagtagctgggactacaggttcctaccaccacacccggccaatttttgtatttttagtagagatggggtttcaccgtatcggcgaggatgatctctatctcttgacctcgtgatctgcccgcctcggcctcccaaagtgctgggattacaggcgtgtgccactgcgctcggcctcagattccatatttgaacaccagctgattgagagaaggggaatgagaagagctggatgagtttaaataactcattgttcagattcctgaacaggagttgggataatggccatcttttctttcctatcctttcttcccccctcactgtgaaaaataacagtccaccccaagtcatacactggacccagtgcctgcggggacaggactgtgggtttcttggtcacacctgtgttggtgctcaatgcagtgtagacatgttttcaaataaaacaaatgattgtgtacaa

SEQ ID NO: 166880 - DNA, 2808 bp, Homo sapiens
  Payload ID: 12851
  Gene Symbol: PDPN
  Gene Name: podoplanin
  Uniprot ID: Q86YL7
  ENST ID: ENST00000617617
  CDS Start-End: 50-766
agaccaccttgcggccgaccccgctcccccgcctcctcgggagagataaatgctgactccgctcggaaagttctcaactgcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctggatgccgaggaagctgctggatgcttaatggtgctagaggctcaagtgtgtttgaaaccaagagccagttgtcccccatgcagaaagaaatcctgtgtgagcctctggtatgagaaataaaatctgccagttttataacattcactttctgcctctgaggaaagatacagggaacaaaaatcaatttgtacagtcttaatattaaaagcagcttgactaaatacctgatttaaaaatagaagacatccccagtcctcatgacataccgcaaatatctgtggggtcctgttgaaaagaacaaaataaaggagcccaaggggtcattctgtctcagcaccatccagcctggcacttctcttcccatatatccattggatttttttttttttttcctaaacaaagtttttacactgagcagatgctctgtcatgatggcggttgtgcaattctggtatcctctaaatttgtaagcattcataaaacaggaaaaagtaaactatcattcggaagcacagcccattcctcccattttttgcaatgatgtctggatgttattttaaacagtgtgtctgtgtgttcccaaatccagctggccccaccagctcagattccattttttttgtgtgtgtgtgtgaaacgtagtctgcaactctgcctcccggcaattatacatgtgtcaggatgtcaaaaagcaattctcctgcctcagcctcctgagtagctgggactacaggttcctaccaccacacccggccaatttttgtatttttagtagagatggggtttcaccgtatcggcgaggatgatctctatctcttgacctcgtgatctgcccgcctcggcctcccaaagtgctgggattacaggcgtgtgccactgcgctcggcctcagattccatatttgaacaccagctgattgagagaaggggaatgagaagagctggatgagtttaaataactcattgttcagattcctgaacaggagttgggataatggccatcttttctttcctatcctttcttcccccctcactgtgaaaaataacagtccaccccaagtcatacactggacccagtgcctgcggggacaggactgtgggtttcttggtcacacctgtgttggtgctcaatgcagtgtagacatgttttcaaataaaacaaatgattgtgt

SEQ ID NO: 166881 - DNA, 6254 bp, Homo sapiens
  Payload ID: 12852
  Gene Symbol: POGK
  Gene Name: pogo transposable element with KRAB domain
  Uniprot ID: Q9P215
  ENST ID: ENST00000367875
  CDS Start-End: 361-2190
ggaaatatcgaaggaaccgactttgaactccagagggatcttttctttggaggttccccgatgcagccctcaagatgcatccgcactccacacctaggaattgcccgcgcccatagagggcaggagtgcggccctttgtactggccaagagtcagcgaatagagaatttgcagcccagaggcaatgggttatttccctgtcggggtgggccccagccgatttctgcacctttttgggtatccaggcataaccctcactatgtttcactgactcctgcgtttgcaaagtcccttaaggtagaatgaccctattttctgaaccagctcgtggacagaacctttgaatttggaaaatccagagatggagtccacagcctaccctctcaatttgagcctgaaagaagaggaagaggaagaagagattcagagccgggaactagaggacggcccggcagacatgcagaaagtacgaatctgctctgagggcggatgggtaccggccctatttgatgaggtggccatatatttttccgatgaggaatgggaagttttgacggagcaacaaaaggccctctaccgggaagtcatgaggatgaattatgaaactgtcctgtccctggaattcccattccctaagccagacatgatcacccgtttggaaggggaggaggagtctcagaattctgacgagtggcagctccaaggaggcacctctgcagaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaagaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcagatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatgggaggaagttaccaccgtacatcattttgaggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaagtgccatatctccagcaacttggaggaggaagacgatgtcctgtgggaaatcgagagtgagttgccaggaggaggagaaccaccaaaagattgtgacaccgaaagcatggctgagagcaactgaagggaaagggaaaggtaaccactcaggagtagatactcagtgcctttgctgacatgtctgtgttctacaaacaccttctctccattatttttctgtttttaagttcccttagagcctacagtgcagtagtgtagatcaggggtccccaacccccaggtcacggaccatactggtccatggcctgtcaggaactgggctgcacagcaggaggtgagcggcaggtgagcaagcattaccacctgagctccgcccgctgtcacagcagcggcattagattctcataggagcacaaaccctgttgtgaactgcacatgtgagggatctaggttgcaggctcctcaatgcctgaggatctgaggcggaacagtttcatcccaaagccatcctaccacccactaccccgcacttcctgggtccctgcaaaaattgtcttccatgaaaccagtccctggtgccagaaaagttggggactgctggtatagataacagaccattagcattttctcctttatatgaaacatttattatttgatttatttgtgtctattttgctctgtggcttggacccagaaacacttgtataataggtgaaatgaacaaagaatgagctgccagaacatctgagagctgtaaagttaaaattatttggacccaaagaagcatagtctgacgttgttcagttcacacaaaattttgtctgaaaagccaacttttttctttcccttttaaattatgctgaacatttagggccagtatgtgtaactgacatgctgggacagttgtactcacttttgctggcctgtaggactgtgacatagggagaacactaagtgtgtcctccgggcctcgggtctcagtcctggagctatctacagtatgttaccagcgagtaagaataatagcttctacttgcttttccctacagagttcaggagttttaaaacgtcatcttagtctcattatgaccttcacatgggctatgacaataatttcctgtagtcagcagatgtctgaaggaagatattttttaactgaatctttacaccaaaaaaagaaaataaaacggtgcgtatctaggactctagtgagggctgaggacaataggcctggaattttctgggttgagtacacaagaagaacagctttcaaaggaaagtaggaatggaggcctaactgagacaacactagtgaaatgaccccacccacctacacctccagagaggaggaggatgagcatgtacagcaggggggacacccacaaagaacaaacaattcatttacctgttcgttctcatctccctaattataaattaaattgatcctccagacagtgttttatatgaaggaagaagccaccttttttacagaggacctgaaaccgtcaaccatcttcacacattctttttctttcttttaaagtataattaggtatttccatcttccttgcttttttctccaaatgaaatgctaatgggagccttattttacccacttcagctatataagtccatctgtgtttcaaagagtgacttatgtctcctgccttgcttccaaattaaattgtactcatattgctgaatcccattgtaattctgggatccctggaattacaatggagcaagaagttcttactattacattcaaaatcaccaaaattgcttttttttcccccttgggtcctccttgctttgagaaaccccatgaatccagcctcccttttctgctgacccttatattgcctgcattggatatcaaactgaattacattgagtttccatcttttcttcatttaccttttgcttttccctctccttgttagataacatttttgtgcacttttaatttcctaagctccttaccacctcagggacatgattaaaaacttccagaagaggaaaggagaaaaagctatgctaagttgcatttatgaatgttggcctgtaatattggtcatgagcttttgctcttctagtctgccacaattctctctgcagctcctgaggaagtgatgggagtagacagattcacagtgaacaagagatttgggagaccaagtgggcataaaactacgtcttggcctctatttggaaatctgaatgatggaattattatgtttgttaaaagttataccaaaaagccaagggttaattcatttaggttctctctgttttccagcaaatggaactctgatttaaacagctggggatgaaattcctcaagatgattattcctgaaagtgtggatgcgctggatgcgcagggaacatcaggaaaaggccacggggctctgaacagccccggtccagacagcagcctgtacatccatcccaggacacagcccagcccctccccacaccatacaaggtatcagaaaagtctaggacctatcatttcatcagagacatgatcagaaaagaaactgcttctgccccatttcttgttttggagattactccatctgtccatcaaaagaaacctgtaaatatgaaagaacaaaggttatttcctggagaaaagacaatttattcaacaccaacgagggactcatcatatgggcacaactctggtgtccttctatggagaaaacctcaagtaaagttttattctgcctttgaaaatgcttccaaaagtagaccctgtccccacacaggtcaagactacagagaaggctttgtagaaatgtgtcacctatgtacacctgctacttacacatttcctcttttggaaaaatgagatacttagaataacaagaaaattaagacatactggcctggtgccagcagatggcttttctatagacaaactaggttagtgtggaagatataggttaaaataaactatgctgttttatttatcttcccaacctgattggcagctagacttttttagggtctcatttaatggccctgtttttttcattattatatttaatgatagggcaggatttcgtatgcaagctcttgtttctcaggctgcctgcagaagaagtcgctataaattatctgttgtctacatggtacaaggcccattgactcatctgatgcttgttttgttaatttctttaatatttttatcacggggcagtgggagggcttgggcttttagccacagctgttttaagacttctgatctcctgccctgcaggaataggtgggaagtcattgaatttttacactatagtaatttgcattcccacataagtttgagtgttacgaaaacattcctttaaagggatctgtgctacacaaaatatgccaggacctcacagacaaagccattgctagaaatgtcattccaatgatcagatctggaaacaggctgccataaccacttttccttcttgtagactcagctcacctgtatatttaaactgttcttggcatcttgaaacacctatttctactcaggtactcattgtcctgttactgattcacctttctgatccttttcaaccagttttcccccaaggggggaaattttacttaacctctagtatttgaacaactcaatatttgaattgttgccccatttgcttttacctgtactgtattcttggtcatctcaaatggcgtctaaacccagctactttgcattccagaagtttccattccctccaattccacctaatttttcatctgtcctagttactggctctttcttcatgtcttatttctcttgctttgggagcttaaaagattttacaagacctaattttgggttccttccttggagccatagttaccctgccaagaagagtagaaaatgggttcaactcctgtttcgctccaccaacacctctgtgagtctcatcatcagctgagcgatgatgccttacaggttgcatagcactggaactttcctagagtaacggctctgctgccagggtttctctgggctcattcttccactgacttaattatgatctatgcctaacagagccccagtacaactattttgcagaatggctgttaccctagaattactatagcacatattgagatatagttgtactccctagtagataggaactgaccccaacaataaactttgataataaagacaata

SEQ ID NO: 166882 - DNA, 5754 bp, Homo sapiens
  Payload ID: 12852
  Gene Symbol: POGK
  Gene Name: pogo transposable element with KRAB domain
  Uniprot ID: Q9P215
  ENST ID: ENST00000367876
  CDS Start-End: 151-1980
accctccctcctcccaccacgtgtcctccccgctccctcccgaggggccgcgcgcacgggaggacggagaggcggaaaggatggcgctgtgacagccgggccggagccctcgcgtccccaccccgcgccctggccgctgggcccggcgagatggagtccacagcctaccctctcaatttgagcctgaaagaagaggaagaggaagaagagattcagagccgggaactagaggacggcccggcagacatgcagaaagtacgaatctgctctgagggcggatgggtaccggccctatttgatgaggtggccatatatttttccgatgaggaatgggaagttttgacggagcaacaaaaggccctctaccgggaagtcatgaggatgaattatgaaactgtcctgtccctggaattcccattccctaagccagacatgatcacccgtttggaaggggaggaggagtctcagaattctgacgagtggcagctccaaggaggcacctctgcagaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaagaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcagatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatgggaggaagttaccaccgtacatcattttgaggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaagtgccatatctccagcaacttggaggaggaagacgatgtcctgtgggaaatcgagagtgagttgccaggaggaggagaaccaccaaaagattgtgacaccgaaagcatggctgagagcaactgaagggaaagggaaagcaaatggaactctgatttaaacagctggggatgaaattcctcaagatgattattcctgaaagtgtggatgcgctggatgcgcagggaacatcaggaaaaggccacggggctctgaacagccccggtccagacagcagcctgtacatccatcccaggacacagcccagcccctccccacaccatacaaggtatcagaaaagtctaggacctatcatttcatcagagacatgatcagaaaagaaactgcttctgccccatttcttgttttggagattactccatctgtccatcaaaagaaacctgtaaatatgaaagaacaaaggttatttcctggagaaaagacaatttattcaacaccaacgagggactcatcatatgggcacaactctggtgtccttctatggagaaaacctcaagtaaagttttattctgcctttgaaaatgcttccaaaagtagaccctgtccccacacaggtcaagactacagagaaggctttgtagaaatgtgtcacctatgtacacctgctacttacacatttcctcttttggaaaaatgagatacttagaataacaagaaaattaagacatactggcctggtgccagcagatggcttttctatagacaaactaggttagtgtggaagatataggttaaaataaactatgctgttttatttatcttcccaacctgattggcagctagacttttttagggtctcatttaatggccctgtttttttcattattatatttaatgatagggcaggatttcgtatgcaagctcttgtttctcaggctgcctgcagaagaagtcgctataaattatctgttgtctacatggtacaaggcccattgactcatctgatgcttgttttgttaatttctttaatatttttatcacggggcagtgggagggcttgggcttttagccacagctgttttaagacttctgatctcctgccctgcaggaataggtgggaagtcattgaatttttacactatagtaatttgcattcccacataagtttgagtgttacgaaaacattcctttaaagggatctgtgctacacaaaatatgccaggacctcacagacaaagccattgctagaaatgtcattccaatgatcagatctggaaacaggctgccataaccacttttccttcttgtagactcagctcacctgtatatttaaactgttcttggcatcttgaaacacctatttctactcaggtactcattgtcctgttactgattcacctttctgatccttttcaaccagttttcccccaaggggggaaattttacttaacctctagtatttgaacaactcaatatttgaattgttgccccatttgcttttacctgtactgtattcttggtcatctcaaatggcgtctaaacccagctactttgcattccagaagtttccattccctccaattccacctaatttttcatctgtcctagttactggctctttcttcatgtcttatttctcttgctttgggagcttaaaagattttacaagacctaattttgggttccttccttggagccatagttaccctgccaagaagagtagaaaatgggttcaactcctgtttcgctccaccaacacctctgtgagtctcatcatcagctgagcgatgatgccttacaggttgcatagcactggaactttcctagagtaacggctctgctgccagggtttctctgggctcattcttccactgacttaattatgatctatgcctaacagagccccagtacaactattttgcagaatggctgttaccctagaattactatagcacatattgagatatagttgtactccctagtagataggaactgaccccaacaataaactttgataataaagacaataggctatggtgattttatttctttacctattagcattgtgaaaagttacattcaaggtattggctacaccttattctccatccggtttggtaccaatatattacatctttcagtcaaaaagtgttcatgagatgcagtgtaagtaatattggtatctgtgaagacacagggaagaacgtgtgcagtggggcaagtttgacataaatagcttttttcctcagtcatgttttgtatgctctcagcagtggtacattaccaaaatcacatgaaagaaatcccataaagggatctgaattttaaatgaaagtatgatgaacccgcaagtcttaattatgcacttttaataaaattagtcctgacaatttacagtgcccataaagtagtagttgattctccaggaataatctggcagtgttatttttccttttcaacccatcagcattaaatgctgagccactctccaagtctgacccctagactaagcttccttactcttactcttcctcccagaggcattttggaatgagtcaaaggcatggtaggacacggcatttacctgtggtcatcacttcaggcaatggaaaggaaaagtgtttgtccttggttgatcagagaagtgggtgataagaacgtgctaaataacaaacctgcacacttgtacctctgaacctaaaatgttttttttttaattcagaacaacaaaagaacatgctaagcgagtcctcccacctgcctggtaaaatacagccagctttatcacacctggttttgcacagtgataaattcctgcaggaaaaaataagttttattctaagtctgaaattatatggtttccaacagctttttccctcgttaaaataattatttttctacatgatgcttgataataagcatttgtttcttaacctaattagagaagcgattgcactcgagtccccacagctggcagtggtgttacagatggaaccagcctttggtggacagagttcagatgtttcaggggctcttgtgaaaatgctaagtattactgtttctaccttactgccctgcactttaccccatcatctcccctccttagaaaatgatttcataggaaaattggcatggagagcagatagtagagtgtagacctgaaatacatgaggcaaaggcagtcttccagcattctatggtcccaccaggtgggtaggtgactaggaattcaggccaggtcctagagagtagtgagaagttttccagtttgcagtttcctctgtgctgtatgtacagccatacagcctatggaacctgacattgcagtgggcagcaggacacggtcaaggctcctagctgcctctccatctatggaactatgaaatttcacacatattccctaggcagcattaaggcccaggtatattgagtagtccaaaccaaaaaactatattcgagtatcagtttaaattcttccaagccctaaaaattcttacgtagtttctcacctaaaactaatggcttgtgccaagaactgaaactaagctattgatttttttttaagaagtcttaatctatacataagaaattacatacctggccaggtgcagtagttcaggcctgtaatcctaacaaacactctgggaggccaaggtgggcagactgcttgagctcaggagttcattaccagtctgggcaacatgataaaaccgtgtctttacaaaaaaaaaaaattttaaattagccgggcatggtggtgtgaatctgtagtcccagctacttaggaggttgcgatgggagaatcacctgagcccagaggtccagtctgcagtgagccatgatcacaccacagcactccagctggggtgacagagtgagaccctatctcaaaaagaaaag

SEQ ID NO: 166883 - DNA, 954 bp, Homo sapiens
  Payload ID: 12852
  Gene Symbol: POGK
  Gene Name: pogo transposable element with KRAB domain
  ENST ID: ENST00000449930
  CDS Start-End: 326-954
tccgggccggaccctccctcctcccaccacgtgtcctccccgctccctcccgaggggccgcgcgcacgggaggacggagaggcggaaaggatggcgctgtgacagccgggccggagccctcgcgtccccaccccgcgccctggccgctgggcccggcggtgagtgcgcgcgggcgggggcggcggcggcgcggcccctcccccgggtcccgggcggctgggccgcggcagaggcgggggcgccgaggctgcgccgccgccgccgccgcctttgttgcgggcccgccggggaggcgggcggcgccggctctcgccgcccggcagagatggagtccacagcctaccctctcaatttgagcctgaaagaagaggaagaggaagaagagattcagagccgggaactagaggacggcccggcagacatgcagaaagtacgaatctgctctgagggcggatgggtaccggccctatttgatgaggtggccatatatttttccgatgaggaatgggaagttttgacggagcaacaaaaggccctctaccgggaagtcatgaggatgaattatgaaactgtcctgtccctggaattcccattccctaagccagacatgatcacccgtttggaaggggaggaggagtctcagaattctgacgagtggcagctccaaggaggcacctctgcagaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtgga

SEQ ID NO: 166884 - DNA, 6626 bp, Homo sapiens
  Payload ID: 12853
  Gene Symbol: POGZ
  Gene Name: pogo transposable element with ZNF domain
  Uniprot ID: Q7Z3K3
  ENST ID: ENST00000271715
  CDS Start-End: 316-4548
ggggggagtcggcgtctctctcccccgcgccagctcccgtacacggagccgcattccttggcccccccacccccctccctcggggcccccccgcccccctcgggaaaaaaatccaccccgaatcactcgaacccgagggaggcttcctttcacccttggggagacgagctttcaacggttacctcttcttcgtctccccccaagcccccgtcccctccccctgctcccacccccttctggcgccgggtgtaaggtccctttaaggcgacggcgccttcctcgggtcagactaccggcggcgacgaccacaggagcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgagggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtt

SEQ ID NO: 166885 - DNA, 6054 bp, Homo sapiens
  Payload ID: 12853
  Gene Symbol: POGZ
  Gene Name: pogo transposable element with ZNF domain
  Uniprot ID: Q7Z3K3
  ENST ID: ENST00000368863
  CDS Start-End: 30-3977
agactaccggcggcgacgaccacaggagcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgagggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgt

SEQ ID NO: 166886 - DNA, 6152 bp, Homo sapiens
  Payload ID: 12853
  Gene Symbol: POGZ
  Gene Name: pogo transposable element with ZNF domain
  Uniprot ID: Q7Z3K3
  ENST ID: ENST00000392723
  CDS Start-End: 1-4074
atggcggacaccgacctgttcatggaatgtgaggaggaggagttggagccatggcagaaaatcagtgatgtcattgaggactctgtagttgaagattataattcagtggataaaactaccacagctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgagggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtt

SEQ ID NO: 166887 - DNA, 4813 bp, Homo sapiens
  Payload ID: 12853
  Gene Symbol: POGZ
  Gene Name: pogo transposable element with ZNF domain
  Uniprot ID: Q7Z3K3
  ENST ID: ENST00000409503
  CDS Start-End: 30-4235
agactaccggcggcgacgaccacaggagcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgagggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatg

SEQ ID NO: 166888 - DNA, 199 bp, Homo sapiens
  Payload ID: 12853
  Gene Symbol: POGZ
  Gene Name: pogo transposable element with ZNF domain
  ENST ID: ENST00000439756
  CDS Start-End: 176-199
ctcggcttcccaaaatgttgggattacaggtgggagccaccatgcccggcctgtaaccctaattattaaataatttgctgtggaatggattctaatattcaataatagaagttgtaattctgaacccttggaaatggaggaaggctagaggatatgataaaggagtccaaggagcatggcggacaccgacctgttcatg

SEQ ID NO: 166889 - DNA, 489 bp, Homo sapiens
  Payload ID: 12853
  Gene Symbol: POGZ
  Gene Name: pogo transposable element with ZNF domain
  ENST ID: ENST00000450842
  CDS Start-End: 238-489
tatcaatatggtaacattttgatagattctttggtattcttgtttgtgatattaagccatattcacaaaaacttgtcttttttttttttttgagatggagtctcgctctattgcccaggctggagcgtaatggcgcaatctcggctcactgcaccctccgcctcctgggttcaagcgattctcctccttcagcttcctcagtagctgggattacaggcacgcgccaccacacctggcatggcggacaccgacctgttcatggaatgtgaggaggaggagttggagccatggcagaaaatcagtgatgtcattgaggactctgtagttgaagattataattcagtggataaaactaccacagctggcaatcctttggtccagcaaggtggacagccactcatcctgacccagaatccagccccaggtctgggcacaatggttactcaaccagtattgaggcctgttcaggtcatgcagaatgccaatcat

SEQ ID NO: 166890 - DNA, 526 bp, Homo sapiens
  Payload ID: 12853
  Gene Symbol: POGZ
  Gene Name: pogo transposable element with ZNF domain
  ENST ID: ENST00000441516
  CDS Start-End: 1-181
tggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtaga

SEQ ID NO: 166891 - DNA, 4130 bp, Homo sapiens
  Payload ID: 12853
  Gene Symbol: POGZ
  Gene Name: pogo transposable element with ZNF domain
  Uniprot ID: Q7Z3K3
  ENST ID: ENST00000491586
  CDS Start-End: 30-4130
agactaccggcggcgacgaccacaggagcatggcggacaccgacctgttcatggaatgtgaggaggaggagttggagccatggcagaaaatcagtgatgtcattgaggactctgtagttgaagattataattcagtggataaaactaccacagctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccagccttattttccctcctatgtgactcaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttga

SEQ ID NO: 166892 - DNA, 4415 bp, Homo sapiens
  Payload ID: 12853
  Gene Symbol: POGZ
  Gene Name: pogo transposable element with ZNF domain
  Uniprot ID: Q7Z3K3
  ENST ID: ENST00000531094
  CDS Start-End: 66-4112
aaggtccctttaaggcgacggcgccttcctcgggtcagactaccggcggcgacgaccacaggagcatggcggacaccgacctgttcatggaatgtgaggaggaggagttggagccatggcagaaaatcagtgatgtcattgaggactctgtagttgaagattataattcagtggataaaactaccacagctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgagggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgac

SEQ ID NO: 166893 - DNA, 949 bp, Homo sapiens
  Payload ID: 12853
  Gene Symbol: POGZ
  Gene Name: pogo transposable element with ZNF domain
  ENST ID: ENST00000529669
  CDS Start-End: 1-949
gttcatagtccctatgaatctactaccaagtgcaagatctgtgaatgggcgtttgaaagtgagccactatttctccagcatatgaaggatactcataagcctggagagatgccttatgtttgccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccc

SEQ ID NO: 166894 - DNA, 586 bp, Homo sapiens
  Payload ID: 12853
  Gene Symbol: POGZ
  Gene Name: pogo transposable element with ZNF domain
  ENST ID: ENST00000533351
  CDS Start-End: 168-586
agactaccggcggcgacgaccacaggagagacggggtttcaccacatctctggtcatggtcatggccaggctggttttgaactcctgacctcaagtgatccacccacctcggcctcccaaagtgctgggattacaggcgtgagccactgcaccggtcctggctaagcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactag

SEQ ID NO: 166895 - DNA, 550 bp, Homo sapiens
  Payload ID: 12853
  Gene Symbol: POGZ
  Gene Name: pogo transposable element with ZNF domain
  ENST ID: ENST00000533461
  CDS Start-End: 98-550
tcggctcactgcaccctccgcctcctgggttcaagcgattctcctccttcagcttcctcagtagctgggattacaggcacgcgccaccacacctggcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcact

SEQ ID NO: 166896 - DNA, 561 bp, Homo sapiens
  Payload ID: 12853
  Gene Symbol: POGZ
  Gene Name: pogo transposable element with ZNF domain
  ENST ID: ENST00000594456
  CDS Start-End: 1-329
cgaatcccaagctaggtaaggcttcggaagaggagatggcagagccaggttgggatggtgggtggagaacagatgattatcacttggtcaccgtagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaaggtacaataacctgaaagactctgagcagccagtcattcaaaaacattaataaagtgtttgttgtatcagagctttatactcagaaatagaaaaataaaataaaatacagctgctgtagtttgttcttacagaaactttagtaaggagaaagccacttacaaaaagtgtaactgaatcagctccaagaaattatgtgtgtaattgtgctttggagattagtgaaattgattgattaaagatgggtga

SEQ ID NO: 166897 - DNA, 3132 bp, Homo sapiens
  Payload ID: 12854
  Gene Symbol: PVR
  Gene Name: poliovirus receptor
  ENST ID: ENST00000187830
  CDS Start-End: 184-318
acttgtctggagcttgaagaagtgggtattccccttcccaccccaggcactggaggagcggccccccggggattccaggacctgagctccgggagctggactcgcagcgaccgcggcagagcgagcgggcgccgggaagcgaggagacgcccgcgggaggcccagctgctcggagcaactggcatggcccgagccatggccgccgcgtggccgctgctgctggtggcgctactggtgctgtcctggccacccccaggaaccggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactccaagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctcca

SEQ ID NO: 166898 - DNA, 3166 bp, Homo sapiens
  Payload ID: 12854
  Gene Symbol: PVR
  Gene Name: poliovirus receptor
  Uniprot ID: P15151
  ENST ID: ENST00000344956
  CDS Start-End: 300-1394
agcgggactgagcgccgggagagacctgcgcaggcgcaggcgcgcggggagggccagcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagcgggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaaggtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactccaagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctcca

SEQ ID NO: 166899 - DNA, 1344 bp, Homo sapiens
  Payload ID: 12854
  Gene Symbol: PVR
  Gene Name: poliovirus receptor
  ENST ID: ENST00000406449
  CDS Start-End: 1-1179
atggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtgagcatcaccagagctgccgtaattgagcacctactacgggctctgtgctgagtccttccagtgtgcctctcactgaatcctcaccccactgccatgaggtttcccccatttgactgatgagggtgcagagccagggagccttgttcactggttcattgattacatttacaaatattatttacagagtggga

SEQ ID NO: 166900 - DNA, 3078 bp, Homo sapiens
  Payload ID: 12854
  Gene Symbol: PVR
  Gene Name: poliovirus receptor
  Uniprot ID: P15151
  ENST ID: ENST00000403059
  CDS Start-End: 188-1306
agtcacttgtctggagcttgaagaagtgggtattccccttcccaccccaggcactggaggagcggccccccggggattccaggacctgagctccgggagctggactcgcagcgaccgcggcagagcgagcgggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactccaagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctcca

SEQ ID NO: 166901 - DNA, 3325 bp, Homo sapiens
  Payload ID: 12854
  Gene Symbol: PVR
  Gene Name: poliovirus receptor
  ENST ID: ENST00000425690
  CDS Start-End: 300-1553
agcgggactgagcgccgggagagacctgcgcaggcgcaggcgcgcggggagggccagcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagcgggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactccaagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctcca

SEQ ID NO: 166902 - DNA, 356 bp, Homo sapiens
  Payload ID: 12854
  Gene Symbol: PVR
  Gene Name: poliovirus receptor
  ENST ID: ENST00000587785
  CDS Start-End: 1-211
ctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccga

SEQ ID NO: 166903 - DNA, 1583 bp, Homo sapiens
  Payload ID: 12855
  Gene Symbol: PVRIG
  Gene Name: poliovirus receptor related immunoglobulin domain containing
  Uniprot ID: Q6DKI7
  ENST ID: ENST00000317271
  CDS Start-End: 364-1344
tctgcactgctagggcagaggactgctgtttgctgacacaatcttggtgcgttggaagtgaaagggaagaggcactggtggctgtgctttgggcccgagcagccagaagccagttgccatcacctatgacgaggagacagcgcctggggcagagcccagtatggggcctagccagggctgggttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacctggactggagggggccatggggcaccggaccctggtcctgccctgggtgctgctgaccttgtgtgtcactgcggggaccccggaggtgtgggttcaagttcggatggaggccaccgagctctcgtccttcaccatccgttgtgggttcctggggtctggctccatctccctggtgactgtgagctgggggggccccaacggtgctggggggaccacgctggctgtgttgcacccagaacgtggcatccggcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgccccgccgactcctgcccccattctgcgggcagacctggccgggatcttgggggtctcaggagtcctcctctttggctgtgtctacctccttcatctgctgcgccgacataagcaccgccctgcccctaggctccagccgtcccgcaccagcccccaggcaccgagagcacgagcatgggcaccaagccaggcctcccaggctgctcttcacgtcccttatgccactatcaacaccagctgccgcccagctactttggacacagctcacccccatggggggccgtcctggtgggcgtcactccccacccacgctgcacaccggccccagggccctgccgcctgggcctccacacccatccctgcacgtggcagctttgtctctgttgagaatggactctacgctcaggcaggggagaggcctcctcacactggtcccggcctcactcttttccctgaccctcgggggcccagggccatggaaggacccttaggagttcgatgagagagaccatgaggccactgggctttccccctcccaggcctcctgggtgtcacccccttactttaattcttgggcctccaataagtgtcccataggtgtctggccaggcccacctgctgcggatgtggtctctgtgtgtgcgtgtgtgggcacaggtgtgagtgtgtgagtgacagttaccccatttcagtcatttcctgctgcaactaagtcagcaacacagtttctctgatgtcggc

SEQ ID NO: 166904 - DNA, 5840 bp, Homo sapiens
  Payload ID: 12856
  Gene Symbol: PVRL1
  Gene Name: poliovirus receptor-related 1 (herpesvirus entry mediator C)
  Uniprot ID: Q15223
  ENST ID: ENST00000264025
  CDS Start-End: 532-2085
cgcagccagagccacccgggccgccgaccgccgagccccgcgcccgccgcctgggccccgagccttctgcgccgcccgggtgcgtcccgccaccctcggaggacggccggccatggacgcctgcaagttggagccgagcgggagggtgtgagcgggccggggccaggagcccgcgccgcgcaaccgggcagccgggcgcgccgggggtgggtccctctccccagccccgctctgcgtggaagaagagggcggggaccggcgccgggaggagagcggaggaggcgaaggggcatgactcgtgcaacttgcggcgggcatctgccgagcctctgagccggcggcggcccggggcccggactgcggccgcgcggatcccacccagcccaccccgccccggccgacggctgcagctgacctggatccttcgagcgcccgccgaccgccagcgatcttccctcatcttccgggctggtttctgctgcgcgaggagcgctgccctcgccgcccctctcgccggacccccggcccccgatggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacagaattcccctacaccccgtctcctcccgaacatgggcggcgcgccgggccggtgcccacggccatcattgggggcgtggcggggagcatcctgctggtgttgattgtggtcggcgggatcgtggtcgccctgcgtcggcgccggcacaccttcaagggtgactacagcaccaagaagcacgtgtatggcaacggctacagcaaggcaggcatcccccagcaccacccaccaatggcacagaacctgcagtaccccgacgactcagacgacgagaagaaggccggcccactgggtggaagcagctatgaggaggaggaggaggaggaggagggcggtggagggggcgagcgcaaggtgggcggcccccaccccaaatatgacgaggacgccaagcggccctacttcaccgtggatgaggccgaggcccgtcaggacggctacggggaccggactctgggctaccagtacgaccctgagcagctggacttggctgagaacatggtttctcagaacgacgggtctttcatttccaagaaggagtggtacgtgtagccccccttccagagcctctgtctgtgaccgctcctccccagcccctccccgcacgccccctgcccaccccccacctcccactccaggagctgaacagagacttgcccagctgcccaaagccagccccgaactcctggggggccaggggagcccagggcagccacgacttggctttgtgttttatttcctccctctcctccgcccttccccatggtgttgtgttcgactgtggctttagtgttactgtatcttccctttacgggccccacctgcctgccctctgtgtagggagccctgttctcgtcttgtgtacctgggcatccctccagggtttggggagccagcctcccccgcccccctacactggaatttgtttgtgtttcttcactgggggtggagggctcaaggggctctaagagggaaaagctccccacacccccagatgctgctcctcctcccggctagagggaacccaacacccaccagtgaaatctgatgcagctgggagtttggaccttgggtctagacagctggtgcgcccaagaggtagggggaggggtgcggcttctccccagttcccagggagtcttgtttgttaagcggggccttgggcagtgttttcctgctgagggtggttttacattttttttcctcattggcccacagagagtggagttggcctagctctgacgcgtcccctctttatccccaatgtgccccctccattaggggctccaggtgggctccagcccacacttgctctctgcctctgctgacacgtgcacacacacacacatgcacacactgctcctctctgcctgctttcccctggagtcccatgccctgccccatccagacactgcccaaggcccacccgtctatttccacctcattccccctttaagctgagaatggggtctgcctatagaagcttccagagacagctgagactgggtccccggtgcctccaccctaggatctcaggcctgccccaaactgcttcttacagcgtggaggtttctctgatttctcccttatctagcaacacttggttcttttggctagtcagggctgggatcccagggggatccacctgcaggagtcagaggtaaagaagcatccacacggagggtagtggggaaggaagcccacatggcagaagctctgcaaacacagtccgagggactgaggagtccatacaatgcctcacacacaaaggccattgtcaaagcctcgggcctggcagaaagtgaggggggtggggccgctaggccacctcctgctcagccacccctggtcctcattctgggatgaggggagggcctaggagaagccctccctttcagtgcagattcccttcttgaatgggacattgagttcctatcagccaccccagactgggtcttcccatgtatataatggaggaagacccctcccagccctctcagtcccccagctcaaagtgcctcagttcctccatctgctcccagatcccctggcactctagacaggcatgcccatgggaaggaccctgggatggagaggcaggcttcgcggcccttcatgcctgcccactgggattccagttaactcaccccagggtgtcaggggctctgcaggatggcaagtgttggggaggagggaggcagaccactctgtgccccacgggcactgacccaccctgccataggcttcctaagggagccccccaacccctcccctcccctccctggtgctgctattgaaccccctgccagctccatttctgccctggcaaccctgggcccagcaggtgggtcgtcgttgtctggccctcactgccctggccccagcccaggctgcccagtagccacgtagcagaagtctgaagccatgccagccctggtgcggctctcccctctacacatttggggtactggatagggtgaagttaggggagaaaattgtggagtctttccagccacagggcagagggaggtggaggagctgggctgcttttcccagcagtattagtgtcccccaggacaggggaccttttccacattacatcactgccccatcccaccttacaacactctggcccctctgcttggtccccttttcccccaggcaggaggcaatcccaggggcctgcctgatagaggcatttcctgtccctgtctcctcctgcatctcctttatcctgcactgccaccctctattccccattctgtgttggactttgaaggccccaagcccagccaaagcactgagttcccccttaagacacctccacaccctccccacaagcaaagcacaaattttggggtccatgtagcatgggccacgtaggaggctcctgacttgccaggggcccagcctcagcatacccaccgagcagctgccagcctgggctgagggtgggcatgaggcaggagtcagcacttggacctagggatgtgaggttttctgtgccccaagtttgtgggaaggtgggcactactgctgggcccacagacacagccagctggcaaaagggaggtctagcccagcagagagatgaggacattttgcttctccttcatgcccacagcatgagctgagcttctgctttgctggaaatgaaataaacttggtatgaattgtgccaaggcctccccagttgtcatcctgcctcttgttgccctccctgtccttgccccccaccccacacccatgcccctgtttccttacagattttgatattgttctaatgtgtaatagaaccagccgagtccccttttatcagaagggtctgaaaagcagcagcacagagtaggtgaacacaggcctgcaagtgcgaccacctcagacccagtacgtgtgcccacagtggacacactcacacctccaacacacccacgcgcaggcatgtgtacacgcatgtacacacgcatgcatgcacagccagatggccactcagcacagatgtggcagagggaatggtctgatcctgctgaaagccattaaggagaaacgaatttcccagtgcccgggctgcaagagagccttataggggccctgtttcctgggcatgcgcttcctctgccagccaacccccacttgcccaagtcactggtgcaataacttttctgccttcctcagagcagagaaattgggaattgtgttaggtgggtgtgggcagctctgctgagccaagcagacacggatgtcccctcttctgggaggagggtagtgctcccaggcctcaggagtccagacagagacccccaaagcctgactgccaacagaaaccctctcctagtgaggggcaggtgggtgtgccccaggtccccacacccacagggaggcttcacacactgcccagtaccggggatgccaggaggcaggcccctctgctgctgccactgctgccaacactgcccagcttgtgaggccaggaggagcccctgtcccactcggtgctgctgctcttctgacccctgctgtgaggaatgggattcttggtcgaaaaaattggttttccttttttgtataaatgaaaagaatccaggagaagctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatgggttgaaaatgtactgaggattaaaaatgtacttttttataaataaagtgtttaaaacaaa

SEQ ID NO: 166905 - DNA, 1377 bp, Homo sapiens
  Payload ID: 12856
  Gene Symbol: PVRL1
  Gene Name: poliovirus receptor-related 1 (herpesvirus entry mediator C)
  Uniprot ID: Q15223
  ENST ID: ENST00000341398
  CDS Start-End: 1-1377
atggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacagaaaagccccgcccccagaggggtctgggaagtgcagccaggctcctggcgggcaccgtggccgtgttcctcatcctagttgctgtgctcactgtcttcttcctgtacaaccggcagcagaagagcccaccggagacggatggggccgggaccgaccagcccctctcccagaagccggagccttctcccagcaggcaaagctcccttgtgcctgaggatatccaggttgtccacctggacccagggaggcagcagcagcaagaagaggaggacttgcagaagctgtccctgcagcccccctactatgatctgggggtctccccctcctaccacccctcggtaaggacaaccgaacctcgaggagagtgcccctag

SEQ ID NO: 166906 - DNA, 1059 bp, Homo sapiens
  Payload ID: 12856
  Gene Symbol: PVRL1
  Gene Name: poliovirus receptor-related 1 (herpesvirus entry mediator C)
  Uniprot ID: Q15223
  ENST ID: ENST00000340882
  CDS Start-End: 1-1059
atggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacagctttctgtcaacttatctatccgggcaaagggaggacaagagctaggatgttctga

SEQ ID NO: 166907 - DNA, 2466 bp, Homo sapiens
  Payload ID: 12857
  Gene Symbol: PVRL2
  Gene Name: poliovirus receptor-related 2 (herpesvirus entry mediator B)
  Uniprot ID: Q92692
  ENST ID: ENST00000252483
  CDS Start-End: 1-1617
atggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccgaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagcccccacccccaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatctgaattgggggtagcaattgatactgttttgtaaactacatttcctacaaaatatgaatttatactttgaccagg

SEQ ID NO: 166908 - DNA, 2112 bp, Homo sapiens
  Payload ID: 12857
  Gene Symbol: PVRL2
  Gene Name: poliovirus receptor-related 2 (herpesvirus entry mediator B)
  Uniprot ID: Q92692
  ENST ID: ENST00000252485
  CDS Start-End: 352-1791
gagcgagaatggaatcccggggaggaacaggggtggaatccggggggcggggtcagaacgccaggagggggcggggccggagccagggtcggcttgactcgggggagcagcgggtggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaacatca

SEQ ID NO: 166909 - DNA, 650 bp, Homo sapiens
  Payload ID: 12857
  Gene Symbol: PVRL2
  Gene Name: poliovirus receptor-related 2 (herpesvirus entry mediator B)
  ENST ID: ENST00000585601
  CDS Start-End: 1-171
gtcatccacgcagtggacagtctgttcaataccaccttcgtctgcacagtcaccaatgccgtgggcatgggccgcgctgagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaaca

SEQ ID NO: 166910 - DNA, 950 bp, Homo sapiens
  Payload ID: 12857
  Gene Symbol: PVRL2
  Gene Name: poliovirus receptor-related 2 (herpesvirus entry mediator B)
  ENST ID: ENST00000591581
  CDS Start-End: 1-632
ccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaaca

SEQ ID NO: 166911 - DNA, 812 bp, Homo sapiens
  Payload ID: 12857
  Gene Symbol: PVRL2
  Gene Name: poliovirus receptor-related 2 (herpesvirus entry mediator B)
  ENST ID: ENST00000592018
  CDS Start-End: 1-163
gctgcagggggcagaggaggacgaagagaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcaggg

SEQ ID NO: 166912 - DNA, 1549 bp, Homo sapiens
  Payload ID: 12858
  Gene Symbol: PVRL3
  Gene Name: poliovirus receptor-related 3
  Uniprot ID: Q9NQS3
  ENST ID: ENST00000319792
  CDS Start-End: 151-1251
ggccaagtgtcagccggcagcgacggcgctagagctgggagctggggacgcgcgcgccggaccttccacagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaa

SEQ ID NO: 166913 - DNA, 732 bp, Homo sapiens
  Payload ID: 12858
  Gene Symbol: PVRL3
  Gene Name: poliovirus receptor-related 3
  ENST ID: ENST00000486596
  CDS Start-End: 1-732
ggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattccct

SEQ ID NO: 166914 - DNA, 3664 bp, Homo sapiens
  Payload ID: 12858
  Gene Symbol: PVRL3
  Gene Name: poliovirus receptor-related 3
  Uniprot ID: Q9NQS3
  ENST ID: ENST00000485303
  CDS Start-End: 276-1925
agttcccaggagttcgacgcgggcgggtgccgaggggaggggagtggcggcggcggcgggcggctcccgcttcagcctcggcagtggcgtcggcgacggcggtgtcgaggcagccgccagcgttcggccaagtgtcagccggcagcgacggcgctagagctgggagctggggacgcgcgcgccggaccttccacagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttcaaacatgataattattagtttttttttttcctttctggaacatggattttggtacattagcagtagccttattttaatgctttatgtcctaaacatactaatagaaatgaaaagacgcagagagagcatttcggaatactgaagtactagttttagaaatgagactttcagccaacaatctatagaaagaattttatggaccatcttgttttagttatttaatgttgatgttgttcaaatgggtaaatgtacagaaagaaaattttagagtaaacttggaactttggatataactagaaaaaactagattatagaattagtcggtaacacttgctaatggacattggcattcatctcctttttcctcctaagtgtatgtatgtgttttaagatttctgtttttacgattaaaactggaaacatgaggttttttgtttttgtttttttacataattacatatattccttctgaatcatttatcttttgagaaagaaatgttacctaaacttcaaatgtgctttttgtttgtgaggtaattaaattgcttctacagtggaggcttacaaaattattgtgacaactattttgaagctgaaaggatagtttttctattgctaagtcatttgaaaaagtgaccattttgccagtgaaatgaagtggaagttagtaggagaatcataaattaaatatattattttgttaataaaaaggcaaagtagtaggtactttttaaaccctcccaaccagccctttctcaatattcatcaaatctaaaacatttagggggcaaaattctaacatgttcatggtatcttgcaaatagtgaaagctttattctgaaggattataaactagttttcttcattttaactagcactattttgtggaaattagaaacctcttttatttctcttcccaaaagtaatacttattataaggctgtagtatcaggttaaggatacagataaataaagttcacttatatcttcttacaaa

SEQ ID NO: 166915 - DNA, 586 bp, Homo sapiens
  Payload ID: 12858
  Gene Symbol: PVRL3
  Gene Name: poliovirus receptor-related 3
  ENST ID: ENST00000461477
  CDS Start-End: 197-586
ataagtgcatcttgagaataggtgatagaaagccttggctgcaggagacaagcttacaggggacgacagaggcagacaggcacagggagggagggaagaggaaagggctggagggaaaaaggcactagaccgagcgctgggagactggaagggaggcagaagttaagaaagaaaaaagaggtgggcagggtgtagaatggcttgtagccttggaggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaaggg

SEQ ID NO: 166916 - DNA, 564 bp, Homo sapiens
  Payload ID: 12858
  Gene Symbol: PVRL3
  Gene Name: poliovirus receptor-related 3
  ENST ID: ENST00000491525
  CDS Start-End: 513-564
atcatcaggggatctcccggagcgatgcaggacaaggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagcc

SEQ ID NO: 166917 - DNA, 314 bp, Homo sapiens
  Payload ID: 12858
  Gene Symbol: PVRL3
  Gene Name: poliovirus receptor-related 3
  ENST ID: ENST00000485506
  CDS Start-End: 1-96
cctgaacacttgcctttgcagactcagttcaaagaaagagaagttggcaatcttcagcactctacttactataatcctgggacaaaaacacattaagaggaagatggatcaatagttctcaaaggaaaaagatggcagcaacctataagaagatctgagcttctaggaatgatgggctattttttctatttttcagagacttttatagcttataaatacttatcagaagaaattagttccacagaatgacagtgaagttgtgatcacatcccaccaaattgtaattttatatccccttccttcaccaaggttaa

SEQ ID NO: 166918 - DNA, 530 bp, Homo sapiens
  Payload ID: 12858
  Gene Symbol: PVRL3
  Gene Name: poliovirus receptor-related 3
  ENST ID: ENST00000481766
  CDS Start-End: 26-530
ttgtgacttatggaagcttagtggtatggaagcaaaattttcttcaatatggcatccaggagattgtttttcttgcaagactattgactgcccaccattcattctgctaaataagttgagtagggaagacctgttgcattgtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatg

SEQ ID NO: 166919 - DNA, 1876 bp, Homo sapiens
  Payload ID: 12858
  Gene Symbol: PVRL3
  Gene Name: poliovirus receptor-related 3
  Uniprot ID: Q9NQS3
  ENST ID: ENST00000493615
  CDS Start-End: 253-1716
aggctctgtggtaggtgaacctcggcggccggcgtgggctgagggagccgccactgagggtgcgggcgccgcggccggctctgccagccgttctctggagcagcgaggcggttggttgtgcgagcgagtgccgaggactttggctggaaacttttcgccgcgcccggggcgaggccctggaagggccaggccagcgaatgctgagccggcggcccgctgccctcccccgcggccgcgcgggtcgccgtgcggatggccgagggttggcgatggtgcttcgtgcgccgaactccgggtttgctccggggaccgttacttcctcgctcattctctgggaaccctcgtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatgttccatttaagcagacctcttccatagctgtagctggagcggtaattggagctgttcttgcccttttcatcattgctatctttgtgactgtgctgctgactcctcgaaaaaaaagaccatcctatcttgacaaagtgattgaccttccacccacacataaaccacctcctctgtatgaagaacgatccccacctttgcctcagaaagacctatttcagcctgaacacttgcctttgcagactcagttcaaagaaagagaagttggcaatcttcagcactctaatggactaaatagcaggagttttgactatgaagatgagaatccagttggggaagatggcattcagcagatgtaccccctttacaatcaaatgtgctaccaagaccggagccctggcaaacatcatcaaaataacgaccctaagagagtctacatcgacccacgagaacattatgtgtgatttttctctttttccaatgggcgttctaacaaatgtttattcttagattggggagagaagctaaggccaatagttattttactgtctctcatataagaacagtcccactctaagggtattggaagtcttaatgaatgacgtaaagccaatagcaaatttc

SEQ ID NO: 166920 - DNA, 3502 bp, Homo sapiens
  Payload ID: 12859
  Gene Symbol: PVRL4
  Gene Name: poliovirus receptor-related 4
  Uniprot ID: Q96NY8
  ENST ID: ENST00000368012
  CDS Start-End: 304-1836
acgcacctgttctgacctgctgagcaggttcccaggtttctgccgtcgttgttggccacagcgtgggaagcagctctgggggagctcggagctcccgatcacggcttcttgggggtagctacggctgggtgtgtagaacggggccggggctggggctgggtcccctagtggagacccaagtgcgagaggcaagaactctgcagcttcctgccttctgggtcagttccttattcaagtctgcagccggctcccagggagatctcggtggaacttcagaaacgctgggcagtctgcctttcaaccatgcccctgtccctgggagccgagatgtgggggcctgaggcctggctgctgctgctgctactgctggcatcatttacaggccggtgccccgcgggtgagctggagacctcagacgtggtaactgtggtgctgggccaggacgcaaaactgccctgcttctaccgaggggactccggcgagcaagtggggcaagtggcatgggctcgggtggacgcgggcgaaggcgcccaggaactagcgctactgcactccaaatacgggcttcatgtgagcccggcttacgagggccgcgtggagcagccgccgcccccacgcaaccccctggacggctcagtgctcctgcgcaacgcagtgcaggcggatgagggcgagtacgagtgccgggtcagcaccttccccgccggcagcttccaggcgcggctgcggctccgagtgctggtgcctcccctgccctcactgaatcctggtccagcactagaagagggccagggcctgaccctggcagcctcctgcacagctgagggcagcccagcccccagcgtgacctgggacacggaggtcaaaggcacaacgtccagccgttccttcaagcactcccgctctgctgccgtcacctcagagttccacttggtgcctagccgcagcatgaatgggcagccactgacttgtgtggtgtcccatcctggcctgctccaggaccaaaggatcacccacatcctccacgtgtccttccttgctgaggcctctgtgaggggccttgaagaccaaaatctgtggcacattggcagagaaggagctatgctcaagtgcctgagtgaagggcagccccctccctcatacaactggacacggctggatgggcctctgcccagtggggtacgagtggatggggacactttgggctttcccccactgaccactgagcacagcggcatctacgtctgccatgtcagcaatgagttctcctcaagggattctcaggtcactgtggatgttcttgacccccaggaagactctgggaagcaggtggacctagtgtcagcctcggtggtggtggtgggtgtgatcgccgcactcttgttctgccttctggtggtggtggtggtgctcatgtcccgataccatcggcgcaaggcccagcagatgacccagaaatatgaggaggagctgaccctgaccagggagaactccatccggaggctgcattcccatcacacggaccccaggagccagccggaggagagtgtagggctgagagccgagggccaccctgatagtctcaaggacaacagtagctgctctgtgatgagtgaagagcccgagggccgcagttactccacgctgaccacggtgagggagatagaaacacagactgaactgctgtctccaggctctgggcgggccgaggaggaggaagatcaggatgaaggcatcaaacaggccatgaaccattttgttcaggagaatgggaccctacgggccaagcccacgggcaatggcatctacatcaatgggcggggacacctggtctgacccaggcctgcctcccttccctaggcctggctccttctgttgacatgggagattttagctcatcttgggggcctccttaaacacccccatttcttgcggaagatgctccccatcccactgactgcttgacctttacctccaacccttctgttcatcgggagggctccaccaattgagtctctcccaccatgcatgcaggtcactgtgtgtgtgcatgtgtgcctgtgtgagtgttgactgactgtgtgtgtgtggaggggtgactgtccgtggaggggtgactgtgtccgtggtgtgtattatgctgtcatatcagagtcaagtgaactgtggtgtatgtgccacgggatttgagtggttgcgtgggcaacactgtcagggtttggcgtgtgtgtcatgtggctgtgtgtgacctctgcctgaaaaagcaggtattttctcagaccccagagcagtattaatgatgcagaggttggaggagagaggtggagactgtggctcagacccaggtgtgcgggcatagctggagctggaatctgcctccggtgtgagggaacctgtctcctaccacttcggagccatgggggcaagtgtgaagcagccagtccctgggtcagccagaggcttgaactgttacagaagccctctgccctctggtggcctctgggcctgctgcatgtacatattttctgtaaatatacatgcgccgggagcttcttgcaggaatactgctccgaatcacttttaatttttttcttttttttttcttgccctttccattagttgtattttttatttatttttatttttatttttttttagagatggagtctcactatgttgctcaggctggccttgaactcctgggctcaagcaatcctcctgcctcagcctccctagtagctgggactttaagtgtacaccactgtgcctgctttgaatcctttacgaagagaaaaaaaaaattaaagaaagcctttagatttatccaatgtttactactgggattgcttaaagtgaggcccctccaacaccagggggttaattcctgtgattgtgaaaggggctacttccaaggcatcttcatgcaggcagccccttgggagggcacctgagagctggtagagtctgaaattagggatgtgagcctcgtggttactgagtaaggtaaaattgcatccaccattgtttgtgataccttagggaattgcttggacctggtgacaagggctcctgttcaatagtggtgttggggagagagagagcagtgattatagaccgagagagtaggagttgaggtgaggtgaaggaggtgctgggggtgagaatgtcgcctttccccctgggttttggatcactaattcaaggctcttctggatgtttctctgggttggggctggagttcaatgaggtttatttttagctggcccacccagatacactcagccagaatacctagatttagtacccaaactcttcttagtctgaaatctgctggatttctggcctaagggagaggctcccatccttcgttccccagccagcctaggacttcgaatgtggagcctgaagatctaagatcctaacatgtacattttatgtaaatatgtgcatatttgtacataaaatgatattctgtttttaaataaacagacaaaacttgttc

SEQ ID NO: 166921 - DNA, 2227 bp, Homo sapiens
  Payload ID: 12860
  Gene Symbol: PLK1
  Gene Name: polo-like kinase 1
  Uniprot ID: P53350
  ENST ID: ENST00000300093
  CDS Start-End: 112-1923
agtggcgcgcaggcttttgtaacgttcccagcgccgcgtttgaattcggggaggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 166922 - DNA, 711 bp, Homo sapiens
  Payload ID: 12860
  Gene Symbol: PLK1
  Gene Name: polo-like kinase 1
  ENST ID: ENST00000567897
  CDS Start-End: 396-711
tcagcttctggacgcgaggtgctggggggaggggtgctggtaatggacgctagggccctggagtacccagggaggagtcccagtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaag

SEQ ID NO: 166923 - DNA, 582 bp, Homo sapiens
  Payload ID: 12860
  Gene Symbol: PLK1
  Gene Name: polo-like kinase 1
  ENST ID: ENST00000568568
  CDS Start-End: 408-582
agacttcgggccttccgggggagatacgagtcaggaaagggatctggtgctggggactcggagcttccggagtggggctgagagaggacccccagtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagc

SEQ ID NO: 166924 - DNA, 910 bp, Homo sapiens
  Payload ID: 12860
  Gene Symbol: PLK1
  Gene Name: polo-like kinase 1
  ENST ID: ENST00000570220
  CDS Start-End: 65-586
ggggaggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggagggtgagtgtcgctgctggggaactggaactgcctgcggggcagttggagcgcccagacctggagctgctggaaagagtacccagcaagggagagcctgggacttggagctgctagagaagggtgctgggagcctcccgcttacgtatggaaagtgtctttgtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacag

SEQ ID NO: 166925 - DNA, 2960 bp, Homo sapiens
  Payload ID: 12861
  Gene Symbol: PLK2
  Gene Name: polo-like kinase 2
  Uniprot ID: Q9NYY3
  ENST ID: ENST00000274289
  CDS Start-End: 302-2359
gcgcgcggctccgctgggaagcgagacccgggtggcgggacaagacttgcttcccggccacgcgcgctcggccggccgtggggcggggcataggccgtgacgtgatgtcgcgtatcgagtctccgcccccttcccgcctccccgtatataagacttcgccgagcgctctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagcggactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggagctccagccacctaccaccacagttgccaggtctggaacacccgcagtagaaaacaagcagcagattggggatgctattcggatgatagtcagagggactcttggcagctgtagcagcagcagtgaatgccttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctctcagaccacaccgtcggtgtccttttcaacaatggtgctcacatgagcctccttccagacaaaaaaacagttcactattacgcagagcttggccaatgctcagttttcccagcaacagatgctcctgagcaatttattagtcaagtgacggtgctgaaatacttttctcattacatggaggagaacctcatggatggtggagatctgcctagtgttactgatattcgaagacctcggctctacctccttcagtggctaaaatctgataaggccctaatgatgctctttaatgatggcacctttcaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactggttggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcagaaa

SEQ ID NO: 166926 - DNA, 2792 bp, Homo sapiens
  Payload ID: 12861
  Gene Symbol: PLK2
  Gene Name: polo-like kinase 2
  ENST ID: ENST00000617412
  CDS Start-End: 181-2196
tccgcccccttcccgcctccccgtatataagacttcgccgagcgctctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagcggactcgaagaagaagcggccgccgcagccccccgaggaatcgcagccacctcagtcccaggcgcaagtgcccccggcgatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggagctccagccacctaccaccacagttgccaggtctggaacacccgcagtagaaaacaagcagcagattggggatgctattcggatgatagtcagagggactcttggcagctgtagcagcagcagtgaatgccttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctctcagaccacaccgtcggtgtccttttcaacaatggtgctcacatgagcctccttccagacaaaaaaacagttcactattacgcagagcttggccaatgctcagttttcccagcaacagatgctcctgagcaatttattagtcaagtgacggtgctgaaatacttttctcattacatggaggagaacctcatggatggtggagatctgcctagtgttactgatattcgaagacctcggctctacctccttcagtggctaaaatctgataaggccctaatgatgctctttaatgatggcacctttcaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactggttggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgc

SEQ ID NO: 166927 - DNA, 2492 bp, Homo sapiens
  Payload ID: 12862
  Gene Symbol: PLK3
  Gene Name: polo-like kinase 3
  Uniprot ID: Q9H4B4
  ENST ID: ENST00000372201
  CDS Start-End: 240-2180
tgggggaggagcttctgggtgatgtaaggccgggaatgggagtggcctctcctcgactcgctgctaggaagggggcgggactctcggtgaccagacgccggggagggggcaggcgttcattgataaaacgctgggctcccctgggcgccagcgcagcgtagcaaatccaggcagcgccacgcgcggccggggccgggcggaaccgagaagccgggaccgcgctgcgacgcgccggccgcatggagcctgccgccggtttcctgtctccgcgccccttccagcgtgcggccgccgcgcccgctcccccggccgggcccgggccgcctccgagtgccttgcgcggacctgagctggagatgctggccgggctaccgacgtcagaccccgggcgcctcatcacggacccgcgcagcggccgcacctacctcaaaggccgcttgttgggcaaggggggcttcgcccgctgctacgaggccactgacacagagactggcagcgcctacgctgtcaaagtcatcccgcagagccgcgtcgccaagccgcatcagcgcgagaagatcctaaatgagattgagctgcaccgagacctgcagcaccgccacatcgtgcgtttttcgcaccactttgaggacgctgacaacatctacattttcttggagctctgcagccgaaagtccctggcccacatctggaaggcccggcacaccctgttggagccagaagtgcgctactacctgcggcagatcctttctggcctcaagtacttgcaccagcgcggcatcttgcaccgggacctcaagttgggaaattttttcatcactgagaacatggaactgaaggtgggggattttgggctggcagcccggttggagcctccggagcagaggaagaagaccatctgtggcacccccaactatgtggctccagaagtgctgctgagacagggccacggccctgaggcggatgtatggtcactgggctgtgtcatgtacacgctgctctgcgggagccctccctttgagacggctgacctgaaggagacgtaccgctgcatcaagcaggttcactacacgctgcctgccagcctctcactgcctgcccggcagctcctggccgccatccttcgggcctcaccccgagaccgcccctctattgaccagatcctgcgccatgacttctttaccaagggctacacccccgatcgactccctatcagcagctgcgtgacagtcccagacctgacaccccccaacccagctaggagtctgtttgccaaagttaccaagagcctctttggcagaaagaagaagagtaagaatcatgcccaggagagggatgaggtctccggtttggtgagcggcctcatgcgcacatccgttggccatcaggatgccaggccagaggctccagcagcttctggcccagcccctgtcagcctggtagagacagcacctgaagacagctcaccccgtgggacactggcaagcagtggagatggatttgaagaaggtctgactgtggccacagtagtggagtcagccctttgtgctctgagaaattgtatagccttcatgcccccagcggaacagaacccggcccccctggcccagccagagcctctggtgtgggtcagcaagtgggttgactactccaataagttcggctttgggtatcaactgtccagccgccgtgtggctgtgctcttcaacgatggcacacatatggccctgtcggccaacagaaagactgtgcactacaatcccaccagcacaaagcacttctccttctccgtgggtgctgtgccccgggccctgcagcctcagctgggtatcctgcggtacttcgcctcctacatggagcagcacctcatgaagggtggagatctgcccagtgtggaagaggtagaggtacctgctccgcccttgctgctgcagtgggtcaagacggatcaggctctcctcatgctgtttagtgatggcactgtccaggtgaacttctacggggaccacaccaagctgattctcagtggctgggagcccctccttgtgacttttgtggcccgaaatcgtagtgcttgtacttacctcgcttcccaccttcggcagctgggctgctctccagacctgcggcagcgactccgctatgctctgcgcctgctccgggaccgcagcccagcctaggacccaagccctgaggcctgaggcctgtgcctgtcaggctctggcccttgcctttgtggccttcccccttcctttggtgcctcactgggggctttgggccgaatcccccagggaatcagggaccagctttactggagttgggggcggcttgtcttcgctggctcctaccccatctccaagataagcctgagccttagctcccagctagggggcgttatttatggaccacttttatttattgtcagacacttatttattgggatgtgagccccaggggggcctcctcctaggataataaacaattttgcagaa

SEQ ID NO: 166928 - DNA, 3841 bp, Homo sapiens
  Payload ID: 12863
  Gene Symbol: PLK4
  Gene Name: polo-like kinase 4
  Uniprot ID: O00444
  ENST ID: ENST00000270861
  CDS Start-End: 275-3187
agcctatccggagcgatccatctcgttacgtcaccaccagcctagctcggacggcaagcggcgggagattttcaaaatgggagcccagaggcaccgcccaggcctcggaaggtgtcagggagaactttccgtggtttcagcgtcgtcgcctggagcggcggtttagagagccgagcctgatgggcgccaaggccggctggctgcttggagcgctgcctcgaagggactgcgtgaaggaagctaatccggagaacccaggccagagcctggaaatatggcgacctgcatcggggagaagatcgaggattttaaagttggaaatctgcttggtaaaggatcatttgctggtgtctacagagctgagtccattcacactggtttggaagttgcaatcaaaatgatagataagaaagccatgtacaaagcaggaatggtacagagagtccaaaatgaggtgaaaatacattgccaattgaaacatccttctatcttggagctttataactattttgaagatagcaattatgtgtatctggtattagaaatgtgccataatggagaaatgaacaggtatctaaagaatagagtgaaacccttctcagaaaatgaagctcgacacttcatgcaccagatcatcacagggatgttgtatcttcattctcatggtatactacaccgggacctcacactttctaacctcctactgactcgtaatatgaacatcaagattgctgattttgggctggcaactcaactgaaaatgccacatgaaaagcactatacattatgtggaactcctaactacatttcaccagaaattgccactcgaagtgcacatggccttgaatctgatgtttggtccctgggctgtatgttttatacattacttatcgggagaccacccttcgacactgacacagtcaagaacacattaaataaagtagtattggcagattatgaaatgccatcttttttgtcaatagaggccaaggaccttattcaccagttacttcgtagaaatccagcagatcgtttaagtctgtcttcagtattggaccatccttttatgtcccgaaattcttcaacaaaaagtaaagatttaggaactgtggaagactcaattgatagtgggcatgccacaatttctactgcaattacagcttcttccagtaccagtataagtggtagtttatttgacaaaagaagacttttgattggtcagccactcccaaataaaatgactgtatttccaaagaataaaagttcaactgatttttcttcttcaggagatggaaacagtttttatactcagtggggaaatcaagaaaccagtaatagtggaaggggaagagtaattcaagatgcagaagaaaggccacattctcgataccttcgtagagcttattcctctgatagatctggcacttctaatagtcagtctcaagcaaaaacatatacaatggaacgatgtcactcagcagaaatgctttcagtgtccaaaagatcaggaggaggtgaaaatgaagagaggtactcacccacagacaacaatgccaacatttttaacttctttaaagaaaagacatccagtagttctggatcttttgaaagacctgataacaatcaagcactctccaatcatctttgtccaggaaaaactccttttccatttgcagacccgacacctcagactgaaaccgtacaacagtggtttgggaatctgcaaataaatgctcatttaagaaaaactactgaatatgacagcatcagcccaaaccgggacttccagggccatccagatttgcagaaggacacatcaaaaaatgcctggactgatacaaaagtcaaaaagaactctgatgcttctgataatgcacattctgtaaaacagcaaaataccatgaaatatatgactgcacttcacagtaaacctgagataatccaacaagaatgtgtttttggctcagatcctctttctgaacagagcaagactaggggtatggagccaccatggggttatcagaatcgtacattaagaagcattacatctccgttggttgctcacaggttaaaaccaatcagacagaaaaccaaaaaggctgtggtgagcatacttgattcagaggaggtgtgtgtggagcttgtaaaggagtatgcatctcaagaatatgtgaaagaagttcttcagatatctagtgatggaaatacgatcactatttattatccaaatggtggtagaggttttcctcttgctgatagaccaccctcacctactgacaacatcagtaggtacagctttgacaatttaccagaaaaatactggcgaaaatatcaatatgcttccaggtttgtacagcttgtaagatctaaatctcccaaaatcacttattttacaagatatgctaaatgcattttgatggagaattctcctggtgctgattttgaggtttggttttatgatggggtaaaaatacacaaaacagaagatttcattcaggtgattgaaaagacagggaagtcttacactttaaaaagtgaaagtgaagttaatagcttgaaagaggagataaaaatgtatatggaccatgctaatgagggtcatcgtatttgtttagcactggaatccataatttcagaagaggaaaggaaaactaggagtgctccctttttcccaataatcataggaagaaaacctggtagtactagttcacctaaggccttatcacctcctccttctgtggattcaaattacccaacgagagagagagcatctttcaacagaatggtcatgcatagtgctgcttctccaacacaggcaccaatccttaatccctctatggttacaaatgaaggacttggtcttacaactacagcttctggaacagacatctcttctaatagtctaaaagattgtcttcctaaatcagcacaacttttgaaatctgtttttgtgaaaaatgttggttgggctacacagttaactagtggagctgtgtgggttcagtttaatgatgggtcccagttggttgtgcaggcaggagtgtcttctatcagttatacctcaccaaatggtcaaacaactaggtatggagaaaatgaaaaattaccagactacatcaaacagaaattacagtgtctgtcttccatccttttgatgttttctaatccgactcctaattttcattgattaaaactcctttcagacatataagtttaataaataacttttttgttgactttcaagtaaagtgattttttttaatttaacataaagtcttcagaaagcctttctatgaaagaattttaacctataatgtaaaggatgtattctgagagaacaaagcagaatgaaacttgagtcacttactaaatatagtggatataaaatagaacacctgactttgctcttagaccataacccccgaacttactatgttcatatatttgtattgaacaatcttttaaaagcaaaaatgtaaatgatgtgtagtttatttgtgcttttattgttttccctgcgtctcagacatgttgagaatcatggacaaaacctgctggaattttggaatttttgaagatgtaaataatgtgtatttatgttataagtaacatatgtaaacatgtatatttgttttatatttatttttgtaacaccagtgtctgatgaaacatttttgcaaatgcattttataaaaaaataaatatagtgataagttacattatcttttgattcatttaattaaatacttatttttaaataacttaccagtaaactcactttttaaattttgttgcctgttgaggagccaattaaattttaaatattaattttgcaaatgtt

SEQ ID NO: 166929 - DNA, 3431 bp, Homo sapiens
  Payload ID: 12863
  Gene Symbol: PLK4
  Gene Name: polo-like kinase 4
  ENST ID: ENST00000515069
  CDS Start-End: 227-2905
ggacggcaagcggcgggagattttcaaaatgggagcccagaggcaccgcccaggcctcggaaggtgtcagggagaactttccgtggtttcagcgtcgtcgcctggagcggcggtttagagagccgagcctgatgggcgccaaggccggctggctgcttggagcgctgcctcgaagggactgcgtgaaggaagctaatccggagaacccaggccagagcctggaaatatggcgacctgcatcggggagaagatcgaggattttaaagttggaaatctgcttggtaaaggatcatttgctggtgtctacagagctgagtccattcacactggtttggaagttgcaatcaaaatgatagataagaaagccatgtacaaagcaggaatggtacagagagtccaaaatgaggtgaaaatacattgccaattgaaacatccttctatcttggagctttataactattttgaagatagcaattatgtgtatctggtattagaaatgtgccataatggagaaatgaacaggtatctaaagaatagagtgaaacccttctcagaaaatgaagctcgacacttcatgcaccagatcatcacagggatgttgtatcttcattctcatggtatactacaccgggacctcacactttctaacctcctactgactcgtaatatgaacatcaagattgctgattttgggctggcaactcaactgaaaatgccacatgaaaagcactatacattatgtggaactcctaactacatttcaccagaaattgccactcgaagtgcacatggccttgaatctgatgtttggtccctgggctgtatgttttatacattacttatcgggagaccacccttcgacactgacacagtcaagaacacattaaataaagtagtattggcagattatgaaatgccatcttttttgtcaatagaggccaaggaccttattcaccagttacttcgtagaaatccagcagatcgtttaagtctgtcttcagtattggaccatccttttatgtcccgaaattcttcaacaaaaagtaaagatttaggaactgtggaagactcaattgatagtgggcatgccacaatttctactgcaattacagcttcttccagtaccagtataagtggtagtttatttgacaaaagaagacttttgattggtcagccactcccaaataaaatgactgtatttccaaagaataaaagttcaactgatttttcttcttcaggagatggaaacagtttttatactcagtggggaaatcaagaaaccagtaatagtggaaggggaagagtaattcaagatgcagaagaaaggccacattctcgataccttcgtagagcttattcctctgatagatctggcacttctaatagtcagtctcaagcaaaaacatatacaatggaacgatgtcactcagcagaaatgctttcagtgtccaaaagatcaggaggaggtgaaaatgaagagaggtactcacccacagacaacaatgccaacatttttaacttctttaaagaaaagacatccagtagttctggatcttttgaaagacctgataacaatcaagcactctccaatcatctttgtccaggaaaaactccttttccatttgcagacccgacacctcagactgaaaccgtacaacagtggtttgggaatctgcaaataaatgatcctctttctgaacagagcaagactaggggtatggagccaccatggggttatcagaatcgtacattaagaagcattacatctccgttggttgctcacaggttaaaaccaatcagacagaaaaccaaaaaggctgtggtgagcatacttgattcagaggaggtgtgtgtggagcttgtaaaggagtatgcatctcaagaatatgtgaaagaagttcttcagatatctagtgatggaaatacgatcactatttattatccaaatggtggtagaggttttcctcttgctgatagaccaccctcacctactgacaacatcagtaggtacagctttgacaatttaccagaaaaatactggcgaaaatatcaatatgcttccaggtttgtacagcttgtaagatctaaatctcccaaaatcacttattttacaagatatgctaaatgcattttgatggagaattctcctggtgctgattttgaggtttggttttatgatggggtaaaaatacacaaaacagaagatttcattcaggtgattgaaaagacagggaagtcttacactttaaaaagtgaaagtgaagttaatagcttgaaagaggagataaaaatgtatatggaccatgctaatgagggtcatcgtatttgtttagcactggaatccataatttcagaagaggaaaggaaaactaggagtgctccctttttcccaataatcataggaagaaaacctggtagtactagttcacctaaggccttatcacctcctccttctgtggattcaaattacccaacgagagagagagcatctttcaacagaatggtcatgcatagtgctgcttctccaacacaggcaccaatccttaatccctctatggttacaaatgaaggacttggtcttacaactacagcttctggaacagacatctcttctaatagtctaaaagattgtcttcctaaatcagcacaacttttgaaatctgtttttgtgaaaaatgttggttgggctacacagttaactagtggagctgtgtgggttcagtttaatgatgggtcccagttggttgtgcaggcaggagtgtcttctatcagttatacctcaccaaatggtcaaacaactaggtatggagaaaatgaaaaattaccagactacatcaaacagaaattacagtgtctgtcttccatccttttgatgttttctaatccgactcctaattttcattgattaaaactcctttcagacatataagtttaataaataacttttttgttgactttcaagtaaagtgattttttttaatttaacataaagtcttcagaaagcctttctatgaaagaattttaacctataatgtaaaggatgtattctgagagaacaaagcagaatgaaacttgagtcacttactaaatatagtggatataaaatagaacacctgactttgctcttagaccataacccccgaacttactatgttcatatatttgtattgaacaatcttttaaaagcaaaaatgtaaatgatgtgtagtttatttgtgcttttattgttttccctgcgtctcagacatgttgagaatcatggacaaaacctgctggaattttggaatttttgaagatgtaaataatgtgtatttatgttataagtaacatatgtaaacatgtatatttgttttatatttatttttgtaacaccagtgtctgatgaaacatttttgcaaatgcattttataaaaaaataaatatagtgataa

SEQ ID NO: 166930 - DNA, 3195 bp, Homo sapiens
  Payload ID: 12863
  Gene Symbol: PLK4
  Gene Name: polo-like kinase 4
  ENST ID: ENST00000507249
  CDS Start-End: 207-2936
ttttcaaaatgggagcccagaggcaccgcccaggcctcggaaggtgtcagggagaactttccgtggtttcagcgtcgtcgcctggagcggcggtttagagagccgagcctgatgggcgccaaggccggctggctgcttggagcgctgcctcgaagggactgcgtgaaggaagctaatccggagaacccaggccagagcctggaaatatggcgacctgcatcggggagaagatcgaggattttaaagttggaaatctgcttggtaaaggatcatttgctggtgtctacagagctgagtccattcacactggtttggaagttgcaatcaaaatgatagataagaaagccatgtacaaagcaggaatggtacagagagtccaaaatgaggtgaaaatacattgccaattgaaacatccttctatcttggagctttataactattttgaagatagcaattatgtgtatctggtattagaaatgtgccataatggagaaatgaacaggtatctaaagaatagagtgaaacccttctcagaaaatgaagctcgacacttcatgcaccagatcatcacagggatgttgtatcttcattctcatggtatactacaccgggacctcacactttctaacctcctactgactcgtaatatgaacatcaagattgctgattttgggctggcaactcaactgaaaatgccacatgaaaagcactatacattatgtggaactcctaactacatttcaccagaaattgccactcgaagtgcacatggccttgaatctgatgtttggtccctgggctgtatgttttatacattacttatcgggagaccacccttcgacactgacacagtcaagaacacattaaataaagtagtattggcagattatgaaatgccatcttttttgtcaatagaggccaaggaccttattcaccagttacttcgtagaaatccagcagatcgtttaagtctgtcttcagtattggaccatccttttatgtcccgaaattcttcaacaaaaagtaaagatttaggaactgtggaagactcaattgatagtgggcatgccacaatttctactgcaattacagcttcttccagtaccagtataagtggtagtttatttgacaaaagaagacttttgattggtcagccactcccaaataaaatgactgtatttccaaagaataaaagttcaactgatttttcttcttcaggagatggaaacagtttttatactcagtggggaaatcaagaaaccagtaatagtggaaggggaagagtaattcaagatgcagaagaaaggccacattctcgataccttcgtagagcttattcctctgatagatctggcacttctaatagtcagtctcaagcaaaaacatatacaatggaacgatgtcactcagcagaaatgctttcagtgtccaaaagatcaggaggaggtgaaaatgaagagagctccaatcatctttgtccaggaaaaactccttttccatttgcagacccgacacctcagactgaaaccgtacaacagtggtttgggaatctgcaaataaatgctcatttaagaaaaactactgaatatgacagcatcagcccaaaccgggacttccagggccatccagatttgcagaaggacacatcaaaaaatgcctggactgatacaaaagtcaaaaagaactctgatgcttctgataatgcacattctgtaaaacagcaaaataccatgaaatatatgactgcacttcacagtaaacctgagataatccaacaagaatgtgtttttggctcagatcctctttctgaacagagcaagactaggggtatggagccaccatggggttatcagaatcgtacattaagaagcattacatctccgttggttgctcacaggttaaaaccaatcagacagaaaaccaaaaaggctgtggtgagcatacttgattcagaggagatcactatttattatccaaatggtggtagaggttttcctcttgctgatagaccaccctcacctactgacaacatcagtaggtacagctttgacaatttaccagaaaaatactggcgaaaatatcaatatgcttccaggtttgtacagcttgtaagatctaaatctcccaaaatcacttattttacaagatatgctaaatgcattttgatggagaattctcctggtgctgattttgaggtttggttttatgatggggtaaaaatacacaaaacagaagatttcattcaggtgattgaaaagacagggaagtcttacactttaaaaagtgaaagtgaagttaatagcttgaaagaggagataaaaatgtatatggaccatgctaatgagggtcatcgtatttgtttagcactggaatccataatttcagaagaggaaaggaaaactaggagtgctccctttttcccaataatcataggaagaaaacctggtagtactagttcacctaaggccttatcacctcctccttctgtggattcaaattacccaacgagagagagagcatctttcaacagaatggtcatgcatagtgctgcttctccaacacaggcaccaatccttaatccctctatggttacaaatgaaggacttggtcttacaactacagcttctggaacagacatctcttctaatagtctaaaagattgtcttcctaaatcagcacaacttttgaaatctgtttttgtgaaaaatgttggttgggctacacagttaactagtggagctgtgtgggttcagtttaatgatgggtcccagttggttgtgcaggcaggagtgtcttctatcagttatacctcaccaaatggtcaaacaactaggtatggagaaaatgaaaaattaccagactacatcaaacagaaattacagtgtctgtcttccatccttttgatgttttctaatccgactcctaattttcattgattaaaactcctttcagacatataagtttaataaataacttttttgttgactttcaagtaaagtgattttttttaatttaacataaagtcttcagaaagcctttctatgaaagaattttaacctataatgtaaaggatgtattctgagagaacaaagcagaatgaaacttgagtcacttactaaatatagtggatataaaatagaacacctgactttgctcttagaccataacccccgaacttactatgttcatatattt

SEQ ID NO: 166931 - DNA, 3060 bp, Homo sapiens
  Payload ID: 12863
  Gene Symbol: PLK4
  Gene Name: polo-like kinase 4
  Uniprot ID: O00444
  ENST ID: ENST00000514379
  CDS Start-End: 233-3022
gggaaggggagcgaacgaagctaacggctgcggggcgggcaccgaggtgcttagggagggtcccaacggcccagacccctgctgtttaggggcggagcggcccgcccctcaagagacaagagtagggaaggcgggacaggattttaaagttggaaatctgcttggtaaaggatcatttgctggtgtctacagagctgagtccattcacactggtttggaagttgcaatcaaaatgatagataagaaagccatgtacaaagcaggaatggtacagagagtccaaaatgaggtgaaaatacattgccaattgaaacatccttctatcttggagctttataactattttgaagatagcaattatgtgtatctggtattagaaatgtgccataatggagaaatgaacaggtatctaaagaatagagtgaaacccttctcagaaaatgaagctcgacacttcatgcaccagatcatcacagggatgttgtatcttcattctcatggtatactacaccgggacctcacactttctaacctcctactgactcgtaatatgaacatcaagattgctgattttgggctggcaactcaactgaaaatgccacatgaaaagcactatacattatgtggaactcctaactacatttcaccagaaattgccactcgaagtgcacatggccttgaatctgatgtttggtccctgggctgtatgttttatacattacttatcgggagaccacccttcgacactgacacagtcaagaacacattaaataaagtagtattggcagattatgaaatgccatcttttttgtcaatagaggccaaggaccttattcaccagttacttcgtagaaatccagcagatcgtttaagtctgtcttcagtattggaccatccttttatgtcccgaaattcttcaacaaaaagtaaagatttaggaactgtggaagactcaattgatagtgggcatgccacaatttctactgcaattacagcttcttccagtaccagtataagtggtagtttatttgacaaaagaagacttttgattggtcagccactcccaaataaaatgactgtatttccaaagaataaaagttcaactgatttttcttcttcaggagatggaaacagtttttatactcagtggggaaatcaagaaaccagtaatagtggaaggggaagagtaattcaagatgcagaagaaaggccacattctcgataccttcgtagagcttattcctctgatagatctggcacttctaatagtcagtctcaagcaaaaacatatacaatggaacgatgtcactcagcagaaatgctttcagtgtccaaaagatcaggaggaggtgaaaatgaagagaggtactcacccacagacaacaatgccaacatttttaacttctttaaagaaaagacatccagtagttctggatcttttgaaagacctgataacaatcaagcactctccaatcatctttgtccaggaaaaactccttttccatttgcagacccgacacctcagactgaaaccgtacaacagtggtttgggaatctgcaaataaatgctcatttaagaaaaactactgaatatgacagcatcagcccaaaccgggacttccagggccatccagatttgcagaaggacacatcaaaaaatgcctggactgatacaaaagtcaaaaagaactctgatgcttctgataatgcacattctgtaaaacagcaaaataccatgaaatatatgactgcacttcacagtaaacctgagataatccaacaagaatgtgtttttggctcagatcctctttctgaacagagcaagactaggggtatggagccaccatggggttatcagaatcgtacattaagaagcattacatctccgttggttgctcacaggttaaaaccaatcagacagaaaaccaaaaaggctgtggtgagcatacttgattcagaggaggtgtgtgtggagcttgtaaaggagtatgcatctcaagaatatgtgaaagaagttcttcagatatctagtgatggaaatacgatcactatttattatccaaatggtggtagaggttttcctcttgctgatagaccaccctcacctactgacaacatcagtaggtacagctttgacaatttaccagaaaaatactggcgaaaatatcaatatgcttccaggtttgtacagcttgtaagatctaaatctcccaaaatcacttattttacaagatatgctaaatgcattttgatggagaattctcctggtgctgattttgaggtttggttttatgatggggtaaaaatacacaaaacagaagatttcattcaggtgattgaaaagacagggaagtcttacactttaaaaagtgaaagtgaagttaatagcttgaaagaggagataaaaatgtatatggaccatgctaatgagggtcatcgtatttgtttagcactggaatccataatttcagaagaggaaaggaaaactaggagtgctccctttttcccaataatcataggaagaaaacctggtagtactagttcacctaaggccttatcacctcctccttctgtggattcaaattacccaacgagagagagagcatctttcaacagaatggtcatgcatagtgctgcttctccaacacaggcaccaatccttaatccctctatggttacaaatgaaggacttggtcttacaactacagcttctggaacagacatctcttctaatagtctaaaagattgtcttcctaaatcagcacaacttttgaaatctgtttttgtgaaaaatgttggttgggctacacagttaactagtggagctgtgtgggttcagtttaatgatgggtcccagttggttgtgcaggcaggagtgtcttctatcagttatacctcaccaaatggtcaaacaactaggtatggagaaaatgaaaaattaccagactacatcaaacagaaattacagtgtctgtcttccatccttttgatgttttctaatccgactcctaattttcattgattaaaactcctttcagacatataagtttaataaataac

SEQ ID NO: 166932 - DNA, 3123 bp, Homo sapiens
  Payload ID: 12863
  Gene Symbol: PLK4
  Gene Name: polo-like kinase 4
  Uniprot ID: O00444
  ENST ID: ENST00000513090
  CDS Start-End: 209-3025
gattttcaaaatgggagcccagaggcaccgcccaggcctcggaaggtgtcagggagaactttccgtggtttcagcgtcgtcgcctggagcggcggtttagagagccgagcctgatgggcgccaaggccggctggctgcttggagcgctgcctcgaagggactgcgtgaaggaagctaatccggagaacccaggccagagcctggaaatatggcgacctgcatcggggagaagatcgaggattttaaagttggaaatctgcttggtaaaggatcatttgctggtgtctacagagctgagtccattcacactggtttggaagttgcaatcaaaatgctttataactattttgaagatagcaattatgtgtatctggtattagaaatgtgccataatggagaaatgaacaggtatctaaagaatagagtgaaacccttctcagaaaatgaagctcgacacttcatgcaccagatcatcacagggatgttgtatcttcattctcatggtatactacaccgggacctcacactttctaacctcctactgactcgtaatatgaacatcaagattgctgattttgggctggcaactcaactgaaaatgccacatgaaaagcactatacattatgtggaactcctaactacatttcaccagaaattgccactcgaagtgcacatggccttgaatctgatgtttggtccctgggctgtatgttttatacattacttatcgggagaccacccttcgacactgacacagtcaagaacacattaaataaagtagtattggcagattatgaaatgccatcttttttgtcaatagaggccaaggaccttattcaccagttacttcgtagaaatccagcagatcgtttaagtctgtcttcagtattggaccatccttttatgtcccgaaattcttcaacaaaaagtaaagatttaggaactgtggaagactcaattgatagtgggcatgccacaatttctactgcaattacagcttcttccagtaccagtataagtggtagtttatttgacaaaagaagacttttgattggtcagccactcccaaataaaatgactgtatttccaaagaataaaagttcaactgatttttcttcttcaggagatggaaacagtttttatactcagtggggaaatcaagaaaccagtaatagtggaaggggaagagtaattcaagatgcagaagaaaggccacattctcgataccttcgtagagcttattcctctgatagatctggcacttctaatagtcagtctcaagcaaaaacatatacaatggaacgatgtcactcagcagaaatgctttcagtgtccaaaagatcaggaggaggtgaaaatgaagagaggtactcacccacagacaacaatgccaacatttttaacttctttaaagaaaagacatccagtagttctggatcttttgaaagacctgataacaatcaagcactctccaatcatctttgtccaggaaaaactccttttccatttgcagacccgacacctcagactgaaaccgtacaacagtggtttgggaatctgcaaataaatgctcatttaagaaaaactactgaatatgacagcatcagcccaaaccgggacttccagggccatccagatttgcagaaggacacatcaaaaaatgcctggactgatacaaaagtcaaaaagaactctgatgcttctgataatgcacattctgtaaaacagcaaaataccatgaaatatatgactgcacttcacagtaaacctgagataatccaacaagaatgtgtttttggctcagatcctctttctgaacagagcaagactaggggtatggagccaccatggggttatcagaatcgtacattaagaagcattacatctccgttggttgctcacaggttaaaaccaatcagacagaaaaccaaaaaggctgtggtgagcatacttgattcagaggaggtgtgtgtggagcttgtaaaggagtatgcatctcaagaatatgtgaaagaagttcttcagatatctagtgatggaaatacgatcactatttattatccaaatggtggtagaggttttcctcttgctgatagaccaccctcacctactgacaacatcagtaggtacagctttgacaatttaccagaaaaatactggcgaaaatatcaatatgcttccaggtttgtacagcttgtaagatctaaatctcccaaaatcacttattttacaagatatgctaaatgcattttgatggagaattctcctggtgctgattttgaggtttggttttatgatggggtaaaaatacacaaaacagaagatttcattcaggtgattgaaaagacagggaagtcttacactttaaaaagtgaaagtgaagttaatagcttgaaagaggagataaaaatgtatatggaccatgctaatgagggtcatcgtatttgtttagcactggaatccataatttcagaagaggaaaggaaaactaggagtgctccctttttcccaataatcataggaagaaaacctggtagtactagttcacctaaggccttatcacctcctccttctgtggattcaaattacccaacgagagagagagcatctttcaacagaatggtcatgcatagtgctgcttctccaacacaggcaccaatccttaatccctctatggttacaaatgaaggacttggtcttacaactacagcttctggaacagacatctcttctaatagtctaaaagattgtcttcctaaatcagcacaacttttgaaatctgtttttgtgaaaaatgttggttgggctacacagttaactagtggagctgtgtgggttcagtttaatgatgggtcccagttggttgtgcaggcaggagtgtcttctatcagttatacctcaccaaatggtcaaacaactaggtatggagaaaatgaaaaattaccagactacatcaaacagaaattacagtgtctgtcttccatccttttgatgttttctaatccgactcctaattttcattgattaaaactcctttcagacatataagtttaataaataacttttttgttgactttcaagtaaagtgattttttttaatttaacataaagtcttcagaaag

SEQ ID NO: 166933 - DNA, 596 bp, Homo sapiens
  Payload ID: 12863
  Gene Symbol: PLK4
  Gene Name: polo-like kinase 4
  ENST ID: ENST00000508113
  CDS Start-End: 1-596
ttcagatatctagtgatggaaatacgaaaaatactggcgaaaatatcaatatgcttccagggtcatcgtatttgtttagcactggaatccataatttcagaagaggaaaggaaaactaggagtgctccctttttcccaataatcataggaagaaaacctggtagtactagttcacctaaggccttatcacctcctccttctgtggattcaaattacccaacgagagagagagcatctttcaacagaatggtcatgcatagtgctgcttctccaacacaggcaccaatccttaatccctctatggttacaaatgaaggacttggtcttacaactacagcttctggaacagacatctcttctaatagtctaaaagattgtcttcctaaatcagcacaacttttgaaatctgtttttgtgaaaaatgttggttgggctacacagttaactagtggagctgtgtgggttcagtttaatgatgggtcccagttggttgtgcaggcaggagtgtcttctatcagttatacctcaccaaatggtcaaacaactaggtatggagaaaatgaaaaattaccagactacatcaaacagaaattaca

SEQ ID NO: 166934 - DNA, 900 bp, Homo sapiens
  Payload ID: 12864
  Gene Symbol: PLK5
  Gene Name: polo-like kinase 5
  Uniprot ID: Q496M5
  ENST ID: ENST00000588430
  CDS Start-End: 1-900
atgtacacggtgctgactggcaccccacccttcatggcctcacccctgtcggagatgtaccaaaacatccgtgagggccactaccccgaacccgctcacctgtctgccaatgcgcgccgcctcatcgtgcacctcctagcacccaacccggccgagcggcccagcctggaccacctgctgcaggacgacttcttcacacagggtttcactccagaccggctgccggcccactcctgccacagtccccccatcttcgccatacccccgcctctgggcaggatcttccggaaggtgggccagcggctgctcacccagtgccggccaccctgccccttcacgcctaaagaggcctcgggtccaggagaaggtgggccagaccctgactccatggagtgggacggcgagagctccctgtctgcgaaagaggttccctgcctggaaggccccatccacctggtcgcacaagggaccctgcagagtgacctggccgggcccgaggggagccggcggccagaggtggaggcggccctcagacacctgcagctgtgcctggatgtaggccccccggccacacaggaccccctgggagagcagcagcccatcctctgggcccccaaatgggtggattattccagcaaatacggctttggctaccagctcttggacggggggcgcacgggacggcacccacatggccctgcgaccccccggagggtgagcttcagtggagtcccggcccaactggtgctgagtggcgagggtgagggtttgcagctcaccctctgggagcaggggtcccctggcacctcctactccctggacgtcccgcggagccacggctgcgcccccaccaccggacagcaccttcaccacgccctccgcatgctgcagagtatctag

SEQ ID NO: 166935 - DNA, 2106 bp, Homo sapiens
  Payload ID: 12864
  Gene Symbol: PLK5
  Gene Name: polo-like kinase 5
  Uniprot ID: Q496M5
  ENST ID: ENST00000334770
  CDS Start-End: 890-1900
tgggtgttgtgttgtgtgtccatgcatggtgactctgtgtctgggcgttgcgtgtttgtgtgtcgtattcaggcgtggtgttgtgcatccggtgctgtcttctggtccgtggcctctatgcaccaggcgtggatgtgtctgtgtctgtgtctctgtgccttcttgtgtgcatcatgtcttgtgtgtccaggcgggagggtgggagctgtgtgttgttttttccccggtgtgtgtgtggagagacctggacgcgcctgcgtccctggctgccctgtgcctctgtacgcgctgccagcttgcacacccgtgcacacctgcccactgatctgctgacccctccccacagggcgccttcagccgctgctacaagctgacagacatgtccaccagcgccgtgttcgccctcaaggtggtgccgtgtggcggggctggggccgggtggcttcgcccgcagggaaaggtggagcgtgagattgccctgcatagccgcctgcgaccccgcaacatcgtggctttccacggacactttgctgaccgcgaccacgtgtacatggtgctggagtactgcagccgccagtctttggcccacgtgctgagggcgcggcagatcctgacggagccagaagtgcgcgactacctgcggggcctggtcagcggcctgcgctacctgcaccagcggtgcatcctgcaccgcgacctgaagctcagtaacttcttccttaacaagaacatggaggtgaagattggagacctgggactggcggccaaggtggggccagggggccgctgccacagagtactctgtgggacccctaacttcctggaccctgaggttgtctccagaaacggtcactcctgccagtaggacatctgggctctgggctgcatcatgtacacggtgctgactggcaccccacccttcatggcctcacccctgtcggagatgtaccaaaacatccgtgagggccactaccccgaacccgctcacctgtctgccaatgcgcgccgcctcatcgtgcacctcctagcacccaacccggccgagcggcccagcctggaccacctgctgcaggacgacttcttcacacagggtttcactccagaccggctgccggcccactcctgccacagtccccccatcttcgccatacccccgcctctgggcaggatcttccggaaggtgggccagcggctgctcacccagtgccggccaccctgccccttcacgcctaaagaggcctcgggtccaggagaaggtgggccagaccctgactccatggagtgggacggcgagagctccctgtctgcgaaagaggttccctgcctggaaggccccatccacctggtcgcacaagggaccctgcagagtgacctggccgggcccgaggggagccggcggccagaggtggaggcggccctcagacacctgcagctgtgcctggatgtaggccccccggccacacaggaccccctgggagagcagcagcccatcctctgggcccccaaatgggtggattattccagcaaatacggctttggctaccagctcttggacggggggcgcacgggacggcacccacatggccctgcgaccccccggagggaggggaccctccccacacctgtgccacctgctggacccggcctctgcctcctgcgcttcctggcctctgagcacgccctgctgctgctgttcagcaatgggatggtgcaggtgagcttcagtggagtcccggcccaactggtgctgagtggcgagggtgagggtttgcagctcaccctctgggagcaggggtcccctggcacctcctactccctggacgtcccgcggagccacggctgcgcccccaccaccggacagcaccttcaccacgccctccgcatgctgcagagtatctagtgcccctgagggtcagagtggacccctgcatggtagtgccagggacccaggctccatttccattcctgtggctcccccagaggggctgtcctgggggagggctggggggcacacgggaggtgggttcttgccttgtggcatgactgttcaacccagactttgctgggatctcttcctttttcattaaagacaatttgaaatgctgt

SEQ ID NO: 166936 - DNA, 1930 bp, Homo sapiens
  Payload ID: 12864
  Gene Symbol: PLK5
  Gene Name: polo-like kinase 5
  Uniprot ID: Q496M5
  ENST ID: ENST00000454744
  CDS Start-End: 717-1727
ctcagagcggccccggagcggccgcagcgcggtggtctcggcccggctgcgccagagtccgcgcgatggagccccggccgcggcggcggcgcaggagtcgccccctggtcgccgccttcctgcgagacccgggctcgggccgcgtgtacaggcgcgggaagctgatcggcaagggcgccttcagccgctgctacaagctgacagacatgtccaccagcgccgtgttcgccctcaaggtggtgccgtgtggcggggctggggccgggtggcttcgcccgcagggaaaggtggagcgtgagattgccctgcatagccgcctgcgaccccgcaacatcgtggctttccacggacactttgctgaccgcgaccacgtgtacatggtgctggagtactgcagccgccagtctttggcccacgtgctgagggcgcggcagatcctgacggagccagaagtgcgcgactacctgcggggcctggtcagcggcctgcgctacctgcaccagcggtgcatcctgcaccgcgacctgaagctcagtaacttcttccttaacaagaacatggaggtgaagattggagacctgggactggcggccaaggtggggccagggggccgctgccacagagtactctgtgggacccctaacttcctggaccctgaggttgtctccagaaacggtcactcctgccagtaggacatctgggctctgggctgcatcatgtacacggtgctgactggcaccccacccttcatggcctcacccctgtcggagatgtaccaaaacatccgtgagggccactaccccgaacccgctcacctgtctgccaatgcgcgccgcctcatcgtgcacctcctagcacccaacccggccgagcggcccagcctggaccacctgctgcaggacgacttcttcacacagggtttcactccagaccggctgccggcccactcctgccacagtccccccatcttcgccatacccccgcctctgggcaggatcttccggaaggtgggccagcggctgctcacccagtgccggccaccctgccccttcacgcctaaagaggcctcgggtccaggagaaggtgggccagaccctgactccatggagtgggacggcgagagctccctgtctgcgaaagaggttccctgcctggaaggccccatccacctggtcgcacaagggaccctgcagagtgacctggccgggcccgaggggagccggcggccagaggtggaggcggccctcagacacctgcagctgtgcctggatgtaggccccccggccacacaggaccccctgggagagcagcagcccatcctctgggcccccaaatgggtggattattccagcaaatacggctttggctaccagctcttggacggggggcgcacgggacggcacccacatggccctgcgaccccccggagggaggggaccctccccacacctgtgccacctgctggacccggcctctgcctcctgcgcttcctggcctctgagcacgccctgctgctgctgttcagcaatgggatggtgcaggtgagcttcagtggagtcccggcccaactggtgctgagtggcgagggtgagggtttgcagctcaccctctgggagcaggggtcccctggcacctcctactccctggacgtcccgcggagccacggctgcgcccccaccaccggacagcaccttcaccacgccctccgcatgctgcagagtatctagtgcccctgagggtcagagtggacccctgcatggtagtgccagggacccaggctccatttccattcctgtggctcccccagaggggctgtcctgggggagggctggggggcacacgggaggtgggttcttgccttgtggcatgactgttcaacccagactttgctgggatctcttcctttttcattaaagacaatttgaaatgc

SEQ ID NO: 166937 - DNA, 4128 bp, Homo sapiens
  Payload ID: 12865
  Gene Symbol: PARG
  Gene Name: poly (ADP-ribose) glycohydrolase
  Uniprot ID: Q86W56
  ENST ID: ENST00000402038
  CDS Start-End: 137-3067
ggcagaggctgcaatctcggcactttgggaggccaaggcaggcgctgagaaggaggcgcagtccatctctctcagggttagtgaatgaggctctccgcccgggccggcccggggacagtgcgctgctggtcccagcatgaatgcgggccccggctgtgaaccctgcaccaagcgaccccgctggggcgccgctacaacttcgccggctgcttcggacgcccggagctttcccagcaggcagaggcgcgtcctcgaccccaaggacgctcacgtgcagttcagggtcccaccgtcctcgccagcctgcgtcccagggcgggcgggacagcacagaggcagcgccacctcgcttgttttcaaacaaaagactattaccagttggatggacactaaaggaatcaagacagcggaatcagaaagtttggatagtaaagaaaacaacaatacaagaatagaatccatgatgagttctgtacaaaaagataacttttaccaacataatgtagaaaaattagaaaatgtttctcagctaagtcttgataagtcacccactgaaaaaagtacacagtatttgaaccagcatcagactgcagcaatgtgtaagtggcaaaatgaagggaaacacacggagcagcttttggaaagtgaacctcaaacagtaaccctggtaccagagcagtttagtaatgctaacattgatcggtcacctcaaaatgatgatcacagtgacacagatagtgaagagaatagagacaatcaacagtttctcacaactgtaaagcttgcaaatgcaaagcagactacagaagatgaacaggccagagaagccaaaagccaccagaagtgcagcaagtcttgcgatcctggggaagactgtgcaagttgtcagcaagatgagatagatgtggtgccagagagtccattgtcagatgttggctctgaggatgttggtactgggccaaaaaatgacaacaaattgactagacaagaaagttgcctaggaaattctcctccatttgagaaggaaagtgaacccgagtcaccgatggatgtggataattctaaaaatagttgtcaagactcagaagcagatgaggagacaagtccaggttttgatgaacaagaagatggtagttcctcccaaacagcaaataaaccttcaaggttccaagcaagagacgctgacattgaatttaggaaacggtactctactaagggcggtgaagttagattacatttccaatttgaaggaggagagagtcgcactggaatgaatgatttaaatgctaaactacctggaaatatttctagcctgaatgtagaatgcagaaattctaagcaacatggaaaaaaggattctaaaatcacagatcatttcatgagactgcccaaagcagaggacagaagaaaagaacagtgggaaaccaaacatcaaagaacagaaaggaagatccctaaatacgttccacctcacctttctccagataagaagtggcttggaactcccattgaggagatgagaagaatgcctcggtgtgggatccggctgcctctcttgagaccatctgccaatcacacagtaactattcgggtagatcttttgcgagcaggagaagttcctaaaccttttccaacacattataaagatttgtgggataacaagcatgttaaaatgccttgttcagaacaaaatttgtacccagtggaagatgagaatggtgagcgaactgcggggagccggtgggagctcattcagactgcacttctcaacaaatttacacgaccccaaaacttgaaggatgctattctgaaatacaatgtggcatattctaagaaatgggactttacagctttgatcgatttctgggataaggtacttgaagaagcagaagctcaacatttatatcagtccatcttgcctgatatggtgaaaattgcactctgtctgccaaatatttgcacccagccaataccactcctgaaacagaagatgaatcattccatcacaatgtcgcaggaacagattgccagtcttttagctaatgctttcttctgcacatttccacgacgaaatgctaagatgaaatcggagtattctagttacccagacattaacttcaatcgattgtttgagggacgttcatcaaggaaaccggagaaacttaaaacgctcttctgctactttagaagagtcacagagaaaaaacctactgggttggtgacatttacaagacagagtcttgaagattttccagaatgggaaagatgtgaaaaacccttgacacgattgcatgtcacttacgaaggtaccatagaagaaaatggccaaggcatgctacaggtggattttgcaaatcgttttgttggaggtggtgtaaccagtgcaggacttgtgcaagaagaaatccgctttttaatcaatcctgagttgattatttcacggctcttcactgaggtgctggatcacaatgaatgtctaattatcacaggtactgagcagtacagtgaatacacaggctatgctgagacatatcgttggtcccggagccacgaagatgggagtgaaagggacgactggcagcggcgctgcactgagatcgttgccatcgatgctcttcacttcagacgctacctcgatcagtttgtgcctgagaaaatgagacgcgagctgaacaaggcttactgtggatttctccgtcctggagtttcttcagagaatctttctgcagtggccacaggaaactggggctgtggtgcctttgggggtgatgccaggttaaaagccttaatacagatattggcagctgctgcagctgagcgagatgtggtttatttcacctttggggactcagaattgatgagagacatttacagcatgcacattttccttactgaaaggaaactcactgttggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgtggacttagatatgttttgtttctattttcttctatttcagtttttcattctttgatgtttatttcttttgtccatcagatctcttgtgaaatcccatggaaggttgtgctcagcctgtcgggtctctttcttcctgcccatatattataccagttgcttctgcagcccgcagatgccagcgatgccaggaaacaagttgaaatccaggaatctctttaactgattttgctaaaaatctccctgtgagccttccactcaactcttaatatgcttgcattgtttaagtttttaaattctgaaaattaataattagggtttttttcatatgtgttgcataatgcaaacctcctaggttaaaatagtttctttatttaagatagaataatttccagaaattgtacttttgaggtatcatttttatctgtaatggtttgtctgtcttttttcctctgatcagtatttttttataccagttttggagactggctgagatgaaaggaaatgtggaataaaaggaggttttcctgatgtggtgtaaagaaaacagattcaagagaattgaagattttttttgtttcttggtacttttttctttttaaattaggactaatgtttcttttgtggtgcttgaggcatattcatataaccaaagtttgagaactgggaacttcatgctgatttgtacatattgaagtttctctggtattcaaaggttatatagtgaatgaattttcattaataaatcactttgtcagaaactcccatatcatctatattttatatatgtatatataaacgtatgctctttaagtgtgtctatatgtgagcacataaaatctaaataaaattggactggtgggaaacaa

SEQ ID NO: 166938 - DNA, 3473 bp, Homo sapiens
  Payload ID: 12865
  Gene Symbol: PARG
  Gene Name: poly (ADP-ribose) glycohydrolase
  ENST ID: ENST00000614063
  CDS Start-End: 262-513
ccggtggtgggaaagtgaacgaatcccgaatcaaagcggcgcattgaggcaggtggggtgccagtggaagagggaaggcaggcgagtgtttacggcctgacttgggaggccggcggatcagcaattgcagaagcaggcagcggcagagagggaatggtgcaggcaggcgctgagaaggaggcgcagtccatctctctcagggttagtgaatgaggctctccgcccgggccggcccggggacagtgcgctgctggtcccagcatgaatgcgggccccggctgtgaaccctgcaccaagcgaccccgctggggcgccgctacaacttcgccggctgcttcggacgcccggagctttcccagcaggcagaggcgcgtcctcgaccccaaggacgctcacgtgcagttcagggtcccaccgtcctcgccagcctgcgtcccagggcgggcgggacagcacagaggcagcgccacctcgcttgtttggatagtaaagaaaacaacaatacaagaatagaatccatgatgagttctgtacaaaaagataacttttaccaacataatgtagaaaaattagaaaatgtttctcagctaagtcttgataagtcacccactgaaaaaagtacacagtatttgaaccagcatcagactgcagcaatgtgtaagtggcaaaatgaagggaaacacacggagcagcttttggaaagtgaacctcaaacagtaaccctggtaccagagcagtttagtaatgctaacattgatcggtcacctcaaaatgatgatcacagtgacacagatagtgaagagaatagagacaatcaacagtttctcacaactgtaaagcttgcaaatgcaaagcagactacagaagatgaacaggccagagaagccaaaagccaccagaagtgcagcaagtcttgcgatcctggggaagactgtgcaagttgtcagcaagatgagatagatgtggtgccagagagtccattgtcagatgttggctctgaggatgttggtactgggccaaaaaatgacaacaaattgactagacaagaaagttgcctaggaaattctcctccatttgagaaggaaagtgaacccgagtcaccgatggatgtggataattctaaaaatagttgtcaagactcagaagcagatgaggagacaagtccaggttttgatgaacaagaagatggtagttcctcccaaacagcaaataaaccttcaaggttccaagcaagagacgctgacattgaatttaggaaacggtactctactaagggcggtgaagttagattacatttccaatttgaaggaggagagagtcgcactggaatgaatgatttaaatgctaaactacctggaaatatttctagcctgaatgtagaatgcagaaattctaagcaacatggaaaaaaggattctaaaatcacagatcatttcatgagactgcccaaagcagaggacagaagaaaagaacagtgggaaaccaaacatcaaagaacagaaaggaagatccctaaatacgttccacctcacctttctccagataagaagtggcttggaactcccattgaggagatgagaagaatgcctcggtgtgggatccggctgcctctcttgagaccatctgccaatcacacagtaactattcgggtagatcttttgcgagcaggagaagttcctaaaccttttccaacacattataaagatttgtgggataacaagcatgttaaaatgccttgttcagaacaaaatttgtacccagtggaagatgagaatggtgagcgaactgcggggagccggtgggagctcattcagactgcacttctcaacaaatttacacgaccccaaaacttgaaggatgctattctgaaatacaatgtggcatattctaagaaatgggactttacagctttgatcgatttctgggataaggtacttgaagaagcagaagctcaacatttatatcagtccatcttgcctgatatggtgaaaattgcactctgtctgccaaatatttgcacccagccaataccactcctgaaacagaagatgaatcattccatcacaatgtcgcaggaacagattgccagtcttttagctaatgctttcttctgcacatttccacgacgaaatgctaagatgaaatcggagtattctagttacccagacattaacttcaatcgattgtttgagggacgttcatcaaggaaaccggagaaacttaaaacgctcttctgctactttagaagagtcacagagaaaaaacctactgggttggtgacatttacaagacagagtcttgaagattttccagaatgggaaagatgtgaaaaacccttgacacgattgcatgtcacttacgaaggtaccatagaagaaaatggccaaggcatgctacaggtggattttgcaaatcgttttgttggaggtggtgtaaccagtgcaggacttgtgcaagaagaaatccgctttttaatcaatcctgagttgattatttcacggctcttcactgaggtgctggatcacaatgaatgtctaattatcacaggtactgagcagtacagtgaatacacaggctatgctgagacatatcgttggtcccggagccacgaagatgggagtgaaagggacgactggcagcggcgctgcactgagatcgttgccatcgatgctcttcacttcagacgctacctcgatcagtttgtgcctgagaaaatgagacgcgagctgaacaaggcttactgtggatttctccgtcctggagtttcttcagagaatctttctgcagtggccacaggaaactggggctgtggtgcctttgggggtgatgccaggttaaaagccttaatacagatattggcagctgctgcagctgagcgagatgtggtttatttcacctttggggactcagaattgatgagagacatttacagcatgcacattttccttactgaaaggaaactcactgttggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgtggacttagatatgttttgtttctattttcttctatttcagtttttcattctttgatgtttatttcttttgtccatcagatctcttgtgaaatcccatggaaggttgtgctcagcctgtcgggtctctttcttcctgcccatatattataccag

SEQ ID NO: 166939 - DNA, 1487 bp, Homo sapiens
  Payload ID: 12865
  Gene Symbol: PARG
  Gene Name: poly (ADP-ribose) glycohydrolase
  ENST ID: ENST00000610922
  CDS Start-End: 274-507
gacggcagctttccggtggtgggaaagtgaacgaatcccgaatcaaagcggcgcattgaggcaggtggggtgccagtggaagagggaaggcaggcgagtgtttacggcctgacttgggaggccggcggatcagcaattgcagaagcaggcagcggcagagagggaatggtgcaggcaggcgctgagaaggaggcgcagtccatctctctcagggttagtgaatgaggctctccgcccgggccggcccggggacagtgcgctgctggtcccagcatgaatgcgggccccggctgtgaaccctgcaccaagcgaccccgctggggcgccgctacaacttcgccggctgcttcggacgcccggagctttcccagcaggcagaggcgcgtcctcgaccccaaggacgctcacgtgcagttcagggtcccaccgtcctcgccagcctgcgtcccagggcgggcgggacagcacagaggcagcgccacctcgcttgatgtgaaaaacccttgacacgattgcatgtcacttacgaaggtaccatagaagaaaatggccaaggcatgctacaggtggattttgcaaatcgttttgttggaggtggtgtaaccagtgcaggacttgtgcaagaagaaatccgctttttaatcaatcctgagttgattatttcacggctcttcactgaggtgctggatcacaatgaatgtctaattatcacaggtactgagcagtacagtgaatacacaggctatgctgagacatatcgttggtcccggagccacgaagatgggagtgaaagggacgactggcagcggcgctgcactgagatcgttgccatcgatgctcttcacttcagacgctacctcgatcagtttgtgcctgagaaaatgagacgcgagctgaacaaggcttactgtggatttctccgtcctggagtttcttcagagaatctttctgcagtggccacaggaaactggggctgtggtgcctttgggggtgatgccaggttaaaagccttaatacagatattggcagctgctgcagctgagcgagatgtggtttatttcacctttggggactcagaattgatgagagacatttacagcatgcacattttccttactgaaaggaaactcactgttggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgt

SEQ ID NO: 166940 - DNA, 3197 bp, Homo sapiens
  Payload ID: 12865
  Gene Symbol: PARG
  Gene Name: poly (ADP-ribose) glycohydrolase
  Uniprot ID: Q86W56
  ENST ID: ENST00000616448
  CDS Start-End: 261-3191
cggtggtgggaaagtgaacgaatcccgaatcaaagcggcgcattgaggcaggtggggtgccagtggaagagggaaggcaggcgagtgtttacggcctgacttgggaggccggcggatcagcaattgcagaagcaggcagcggcagagagggaatggtgcaggcaggcgctgagaaggaggcgcagtccatctctctcagggttagtgaatgaggctctccgcccgggccggcccggggacagtgcgctgctggtcccagcatgaatgcgggccccggctgtgaaccctgcaccaagcgaccccgctggggcgccgctacaacttcgccggctgcttcggacgcccggagctttcccagcaggcagaggcgcgtcctcgaccccaaggacgctcacgtgcagttcagggtcccaccgtcctcgccagcctgcgtcccagggcgggcgggacagcacagaggcagcgccacctcgcttgttttcaaacaaaagactattaccagttggatggacactaaaggaatcaagacagcggaatcagaaagtttggatagtaaagaaaacaacaatacaagaatagaatccatgatgagttctgtacaaaaagataacttttaccaacataatgtagaaaaattagaaaatgtttctcagctaagtcttgataagtcacccactgaaaaaagtacacagtatttgaaccagcatcagactgcagcaatgtgtaagtggcaaaatgaagggaaacacacggagcagcttttggaaagtgaacctcaaacagtaaccctggtaccagagcagtttagtaatgctaacattgatcggtcacctcaaaatgatgatcacagtgacacagatagtgaagagaatagagacaatcaacagtttctcacaactgtaaagcttgcaaatgcaaagcagactacagaagatgaacaggccagagaagccaaaagccaccagaagtgcagcaagtcttgcgatcctggggaagactgtgcaagttgtcagcaagatgagatagatgtggtgccagagagtccattgtcagatgttggctctgaggatgttggtactgggccaaaaaatgacaacaaattgactagacaagaaagttgcctaggaaattctcctccatttgagaaggaaagtgaacccgagtcaccgatggatgtggataattctaaaaatagttgtcaagactcagaagcagatgaggagacaagtccaggttttgatgaacaagaagatggtagttcctcccaaacagcaaataaaccttcaaggttccaagcaagagacgctgacattgaatttaggaaacggtactctactaagggcggtgaagttagattacatttccaatttgaaggaggagagagtcgcactggaatgaatgatttaaatgctaaactacctggaaatatttctagcctgaatgtagaatgcagaaattctaagcaacatggaaaaaaggattctaaaatcacagatcatttcatgagactgcccaaagcagaggacagaagaaaagaacagtgggaaaccaaacatcaaagaacagaaaggaagatccctaaatacgttccacctcacctttctccagataagaagtggcttggaactcccattgaggagatgagaagaatgcctcggtgtgggatccggctgcctctcttgagaccatctgccaatcacacagtaactattcgggtagatcttttgcgagcaggagaagttcctaaaccttttccaacacattataaagatttgtgggataacaagcatgttaaaatgccttgttcagaacaaaatttgtacccagtggaagatgagaatggtgagcgaactgcggggagccggtgggagctcattcagactgcacttctcaacaaatttacacgaccccaaaacttgaaggatgctattctgaaatacaatgtggcatattctaagaaatgggactttacagctttgatcgatttctgggataaggtacttgaagaagcagaagctcaacatttatatcagtccatcttgcctgatatggtgaaaattgcactctgtctgccaaatatttgcacccagccaataccactcctgaaacagaagatgaatcattccatcacaatgtcgcaggaacagattgccagtcttttagctaatgctttcttctgcacatttccacgacgaaatgctaagatgaaatcggagtattctagttacccagacattaacttcaatcgattgtttgagggacgttcatcaaggaaaccggagaaacttaaaacgctcttctgctactttagaagagtcacagagaaaaaacctactgggttggtgacatttacaagacagagtcttgaagattttccagaatgggaaagatgtgaaaaacccttgacacgattgcatgtcacttacgaaggtaccatagaagaaaatggccaaggcatgctacaggtggattttgcaaatcgttttgttggaggtggtgtaaccagtgcaggacttgtgcaagaagaaatccgctttttaatcaatcctgagttgattatttcacggctcttcactgaggtgctggatcacaatgaatgtctaattatcacaggtactgagcagtacagtgaatacacaggctatgctgagacatatcgttggtcccggagccacgaagatgggagtgaaagggacgactggcagcggcgctgcactgagatcgttgccatcgatgctcttcacttcagacgctacctcgatcagtttgtgcctgagaaaatgagacgcgagctgaacaaggcttactgtggatttctccgtcctggagtttcttcagagaatctttctgcagtggccacaggaaactggggctgtggtgcctttgggggtgatgccaggttaaaagccttaatacagatattggcagctgctgcagctgagcgagatgtggtttatttcacctttggggactcagaattgatgagagacatttacagcatgcacattttccttactgaaaggaaactcactgttggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagcc

SEQ ID NO: 166941 - DNA, 570 bp, Homo sapiens
  Payload ID: 12866
  Gene Symbol: PARP1
  Gene Name: poly (ADP-ribose) polymerase 1
  ENST ID: ENST00000366790
  CDS Start-End: 54-521
gtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggtgtgtacatactggggcagcatgggcattcagcccccaccctgaagctcccaggagggcctcgtctcagagagcaaagcaaacctcccccagcttgccctctcccacatgtgcagatcaagcgtatggtgcccatgttatttcagcaacacctcctggactcagcatcatctgttgcatgatatttggtattttgtttttccaggtgcttggaatgtagcctttaaagtt

SEQ ID NO: 166942 - DNA, 553 bp, Homo sapiens
  Payload ID: 12866
  Gene Symbol: PARP1
  Gene Name: poly (ADP-ribose) polymerase 1
  ENST ID: ENST00000366792
  CDS Start-End: 147-473
ggcggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacagaacctccaataccatgtggaatagaagtgatgggaagatagcttcgtcttattcctaatcttaggcaaaggccaggatggaattggtagcaaggcagagaagactctgggtgactttgcag

SEQ ID NO: 166943 - DNA, 3958 bp, Homo sapiens
  Payload ID: 12866
  Gene Symbol: PARP1
  Gene Name: poly (ADP-ribose) polymerase 1
  Uniprot ID: P09874
  ENST ID: ENST00000366794
  CDS Start-End: 145-3189
cggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaaacaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 166944 - DNA, 477 bp, Homo sapiens
  Payload ID: 12866
  Gene Symbol: PARP1
  Gene Name: poly (ADP-ribose) polymerase 1
  ENST ID: ENST00000629232
  CDS Start-End: 151-477
gaacggcggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacagaacctccaataccatgtggaatagaagtgatgggaagatag

SEQ ID NO: 166945 - DNA, 1886 bp, Homo sapiens
  Payload ID: 12867
  Gene Symbol: PARP2
  Gene Name: poly (ADP-ribose) polymerase 2
  Uniprot ID: Q9UGN5
  ENST ID: ENST00000250416
  CDS Start-End: 28-1779
ggttgatgacgtcagcgttcgaattccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatggtatgccaggaaggtcatgggccagcaaaagggtctctgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagaggaacttcagtgtttggatgagatggggccgagttgggaaaatgggacagcacagcctggtggcttgttcaggcaatctcaacaaggccaaggaaatctttcagaagaaattccttgacaaaacgaaaaacaattgggaagatcgagaaaagtttgagaaggtgcctggaaaatatgatatgctacagatggactatgccaccaatactcaggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttgggaagctgacagtggcacaaatcaaggcaggttaccagtctcttaagaagattgaggattgtattcgggctggccagcatggacgagctctcatggaagcatgcaatgaattctacaccaggattccgcatgactttggactccgtactcctccactaatccggacacagaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatcagaggtagctctaggtcagtgtaatgaactactagaggccaatcctaaggccgaaggattgcttcaaggtaaacatagcaccaaggggctgggcaagatggctcccagttctgcccacttcgtcaccctgaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtcta

SEQ ID NO: 166946 - DNA, 1881 bp, Homo sapiens
  Payload ID: 12867
  Gene Symbol: PARP2
  Gene Name: poly (ADP-ribose) polymerase 2
  Uniprot ID: Q9UGN5
  ENST ID: ENST00000429687
  CDS Start-End: 61-1773
ctagtgacactgggcccgcgattccttggagcgggttgatgacgtcagcgttcgaattccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagaggaacttcagtgtttggatgagatggggccgagttgggaaaatgggacagcacagcctggtggcttgttcaggcaatctcaacaaggccaaggaaatctttcagaagaaattccttgacaaaacgaaaaacaattgggaagatcgagaaaagtttgagaaggtgcctggaaaatatgatatgctacagatggactatgccaccaatactcaggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttgggaagctgacagtggcacaaatcaaggcaggttaccagtctcttaagaagattgaggattgtattcgggctggccagcatggacgagctctcatggaagcatgcaatgaattctacaccaggattccgcatgactttggactccgtactcctccactaatccggacacagaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatcagaggtagctctaggtcagtgtaatgaactactagaggccaatcctaaggccgaaggattgcttcaaggtaaacatagcaccaaggggctgggcaagatggctcccagttctgcccacttcgtcaccctgaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtctac

SEQ ID NO: 166947 - DNA, 717 bp, Homo sapiens
  Payload ID: 12867
  Gene Symbol: PARP2
  Gene Name: poly (ADP-ribose) polymerase 2
  ENST ID: ENST00000529465
  CDS Start-End: 15-347
agcgttcgaattccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatgaatctgtgaaggccttgctgttaaagggcaaagctcctgtggacccagagtgtacagccaaggtggggaaggctcatgtgtattgtgaaggaaatgatgtctatgatgtcatgctaaatcagattccttgacaaaacgaaaaacaattgggaagatcgagaaaagtttgagaaggtgcctggaaaatatgatatgctacagatggactatgccaccaatactcaggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttggcaggttaccagtctcttaagaagattgaggattgtattcgggctggccagcatggacgagctctcatggaagcatgcaatgaattctacaccaggattccgcatgactttgg

SEQ ID NO: 166948 - DNA, 1980 bp, Homo sapiens
  Payload ID: 12867
  Gene Symbol: PARP2
  Gene Name: poly (ADP-ribose) polymerase 2
  ENST ID: ENST00000527915
  CDS Start-End: 6-1601
attccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatggtatgccaggaaggtcatgggccagcaaaagggtctctgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagaggaacttcagtgtttggatgagatggggccgagttgggaaaatgggacagcacagcctggtggcttgttcaggcaatctcaacaaggccaaggaaatctttcagaagaaattccttgacaaaacgaaaaacaattgggaagatcgagaaaagtttgagaaggtgcctggaaaatatgatatgctacagatggactatgccaccaatactcaggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttgggaagctgacagtggcacaaatcaaggcaggttaccagtctcttaagaagattgaggattgtattcgggctggccagcatggacgagctctcatggaagcatgcaatgaattctacaccaggattccgcatgactttggactccgtactcctccactaatccggacacagaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatcagaggtagctctaggtcagtgtaatgaactactagaggccaatcctaaggccgaaggattgcttcaaggtaaacatagcaccaaggggctgggcaagatggctcccagttctgcccacttcgtcaccctgtaagtactcagaaccaggaggactagaagactccttttggccagataagactacgttctctattgcagcttctgaaccagagactgatgttgacacactttttttccatttggcaggaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtct

SEQ ID NO: 166949 - DNA, 635 bp, Homo sapiens
  Payload ID: 12867
  Gene Symbol: PARP2
  Gene Name: poly (ADP-ribose) polymerase 2
  ENST ID: ENST00000539930
  CDS Start-End: 1-532
gaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatcagaggaatgggagtacagtgccattaggaccagcaagtgacacaggaattctgaatccagatggttataccctcaactacaatgaatatattgtatataaccccaaccaggtccgtatgcggtaccttttaaaggttcagttt

SEQ ID NO: 166950 - DNA, 1090 bp, Homo sapiens
  Payload ID: 12868
  Gene Symbol: PARP10
  Gene Name: poly (ADP-ribose) polymerase family, member 10
  ENST ID: ENST00000313059
  CDS Start-End: 72-1090
ggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagatgtccgtgtcctggaggagcaggcccagaatctgggcctggaggggaccttggtgtccctggcccgggttccccaggcccgagcggtgcgtgtggtgggggatggtgcctctgtggacctgctgttgctggagttgtacctggagaatgagcgccgcagtggtggggggcccctggaggacctgcaacgcctacccgggcccctgggcactgttgcctccttccagcagtggcaagtggcagaacgagtgttgcagcaggagcaccggttgcagggctcagagctgagccttgtcccccactacgacatcctggagcccgaggagctggctgagaacaccagtggaggggaccacccgtccacccaggggcctagggctaccaagcatgctctcctgaggaccggagggttggtgacggctctgcagggtgcagggactgtgacaatgggctctggcgaggaaccagggcagtcaggggcctctctgaggacaggtcccatggtgcagggtagagggattatgacaacaggctctggccaggaaccagggcagtcagggacctctctgaggacaggtcccatggggtctctgggacaggcagagcaagtcagctcgatgcccatggggtctctggaacatgaggggctggtaagcctgaggcctgtggggttgcaggaacaggaggggcccatgagcctggggcctgtggggtctgcaggcccagtggagacctctaaggggttgctggggcaggagggcctggtggaaattgccatggactcaccagagcaagaggggctggtgggtcccatggagatcaccatggggtctctgga

SEQ ID NO: 166951 - DNA, 3497 bp, Homo sapiens
  Payload ID: 12868
  Gene Symbol: PARP10
  Gene Name: poly (ADP-ribose) polymerase family, member 10
  Uniprot ID: Q53GL7
  ENST ID: ENST00000313028
  CDS Start-End: 96-3173
gttttcctgctcccagcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggtccagttgcccaagcccctttctgaggcagatgtccgtgtcctggaggagcaggcccagaatctgggcctggaggggaccttggtgtccctggcccgggttccccaggcccgagcggtgcgtgtggtgggggatggtgcctctgtggacctgctgttgctggagttgtacctggagaatgagcgccgcagtggtggggggcccctggaggacctgcaacgcctacccgggcccctgggcactgttgcctccttccagcagtggcaagtggcagaacgagtgttgcagcaggagcaccggttgcagggctcagagctgagccttgtcccccactacgacatcctggagcccgaggagctggctgagaacaccagtggaggggaccacccgtccacccaggggcctagggctaccaagcatgctctcctgaggaccggagggttggtgacggctctgcagggtgcagggactgtgacaatgggctctggcgaggaaccagggcagtcaggggcctctctgaggacaggtcccatggtgcagggtagagggattatgacaacaggctctggccaggaaccagggcagtcagggacctctctgaggacaggtcccatggggtctctgggacaggcagagcaagtcagctcgatgcccatggggtctctggaacatgaggggctggtaagcctgaggcctgtggggttgcaggaacaggaggggcccatgagcctggggcctgtggggtctgcaggcccagtggagacctctaaggggttgctggggcaggagggcctggtggaaattgccatggactcaccagagcaagaggggctggtgggtcccatggagatcaccatggggtctctggagaaggcagggcctgtgagcccaggatgtgtgaagctggcagggcaggagggcctggtggagatggtgctattgatggagccaggggcgatgcgcttcctgcagctctaccatgaggaccttcttgcgggcctgggagacgtcgctctcttgccacttgaaggaccggatatgactggctttcggctctgtggagcccaggcttcctgccaggcggctgaggagtttctgcggagcctgctgggcagcattagctgccatgtgttgtgcctggagcacccgggcagcgccaggtttctcctgggcccagaagggcagcaccttctccaggggctggaggctcagttccagtgtgtctttgggacagagcgcctggccacagccacgttggacacaggccttgaagaggtggaccctaccgaggccctcccagtgctccctggcaacgcccacaccctgtggaccccagacagtacaggtggtgaccaggaggacgtgagcctggaggaggtccgagaactgctggccaccctggagggcctagacctagacggggaggactggctgcctcgggagctggaggaggaagggcctcaggagcagccagaggaggaggtgaccccagggcatgaggaggaggagcctgtggcccccagcactgtggcacccaggtggctggaggaggaggccgctctgcagctggccctccaccggtcactggagcctcaaggtcaggtggctgagcaggaggaggctgctgccctgcggcaagccctaaccctctccctgctggagcagcccccgttggaggcagaagagcccccagatggggggactgatggcaaggcccagctggtggtgcactcggcctttgagcaggatgtggaggagctggaccgggcgctcagggctgccttggaggtccacgtccaggaggagacggtggggccctggcgccgcacactgcctgcagagctgcgtgctcgcctggagcggtgccatggtgtgagtgttgccctgcgtggtgactgcaccatcctccgtggcttcggggcccaccctgcccgtgctgcccgccacttggtggcacttctggctggcccctgggatcagagtttggcctttcccttggcagcttcaggccctaccttggcggggcagacgctgaaggggccctggaacaacctggagcgtctggcagagaacaccggggagttccaggaggtggtgcgggccttctacgacaccctggacgctgcccgcagcagcatccgcgtcgttcgtgtggagcgcgtgtcgcacccgctgctgcagcagcagtatgagctgtaccgggagcgcctgctgcagcgatgcgagcggcgcccggtggagcaggtgctgtaccacggcacgacggcaccggcagtgcctgacatctgcgcccacggcttcaaccgcagcttctgcggccgcaacgccacggtctacgggaagggcgtgtatttcgccaggcgcgcctccctgtcggtgcaggaccgctactcgccccccaacgccgatggccataaggcggtgttcgtggcacgggtgctgactggcgactacgggcagggccgccgcggtctgcgggcgccccctctgcggggtcctggccacgtgctcctgcgctacgacagcgccgtggactgcatctgccagcccagcatcttcgtcatcttccacgacacccaggcgctgcccacccacctcatcacctgcgagcacgtgccccgcgcttcccccgacgacccctctgggctcccgggccgctccccagacacttaaccgaaggggccaccctctggcctcctgcttcccaggctcccagctccgcacaggctgatgctccccgcccccaactgtggccgcctgagctgtccccggggacgcccctgcctccctctgcgggctccagaaggcggtgtgggggatggcggtcagcagcggccgaggggggccgggctaggtcccagcctgggccgaccccaccaccaggggtcagcagagcccaggaggcgacaccgcccgcccgccgctcccagacctcgcccgagtcggctctgttgtttgaataaacgtgaacgtgaacccaggcggaagggacccggg

SEQ ID NO: 166952 - DNA, 899 bp, Homo sapiens
  Payload ID: 12868
  Gene Symbol: PARP10
  Gene Name: poly (ADP-ribose) polymerase family, member 10
  ENST ID: ENST00000528136
  CDS Start-End: 514-899
gaagcgcgtgaggaccggacgggcggcgccgtggggccttcccagggctctaggccgcctttagggtgggggaggggccgggcgaggggacgaccgccagcctcgggatttggggcttgggtcgtttctcacaagcaaccggaggcctgcgccgctgccggcgtctcccgggtgggagctcagcgcggaggctggggtctcggccggggacgtgtggggtgtgcccggaccctcccctccgcatcccgccccttaagcagctttaaggggccggagccggcggctatttctatcccaggaaatccccgggccatctgtgaccaacaaaggcccgagcccccccacccccgcgagcccaacaacagggcccaacggcccctggctccggggtggggggatcgggcctggatcggctgccggtgcctgccagtgggcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagccc

SEQ ID NO: 166953 - DNA, 3469 bp, Homo sapiens
  Payload ID: 12868
  Gene Symbol: PARP10
  Gene Name: poly (ADP-ribose) polymerase family, member 10
  ENST ID: ENST00000524918
  CDS Start-End: 88-3138
gctcccagcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggtccagttgcccaagcccctttctgaggcagatgtccgtgtcctggaggagcaggcccagaatctgggcctggaggggaccttggtgtccctggcccgggttccccaggcccgagcggtgcgtgtggtgggggatggtgcctctgtggacctgctgttgctggagttgtacctggagaatgagcgccgcagtggtggggggcccctggaggacctgcaacgcctacccgggcccctgggcactgttgcctccttccagcagtggcaagtggcagaacgagtgttgcagcaggagcaccggttgcagggctcagagctgagccttgtcccccactacgacatcctggagcccgaggagctggctgagaacaccagtggaggggaccacccgtccacccaggggcctagggctaccaagcatgctctcctgaggaccggagggttggtgacggctctgcagggtgcagggactgtgacaatgggctctggcgaggaaccagggcagtcaggggcctctctgaggacaggtcccatggtgcagggtagagggattatgacaacaggctctggccaggaaccagggcagtcagggacctctctgaggacaggtcccatggggtctctgggacaggcagagcaagtcagctcgatgcccatggggtctctggaacatgaggggctggtaagcctgaggcctgtggggttgcaggaacaggaggggcccatgagcctggggcctgtggggtctgcaggcccagtggagacctctaaggggttgctggggcaggagggcctggtggaaattgccatggactcaccagagcaagaggggctggtgggtcccatggagatcaccatggggtctctggagaaggcagggcctgtgagcccaggatgtgtgaagctggcagggcaggagggcctggtggagatggtgctattgatggagccaggggcgatgcgcttcctgcagctctaccatgaggaccttcttgcgggcctgggagacgtcgctctcttgccacttgaaggaccggatatgactggctttcggctctgtggagcccaggcttcctgccaggcggctgaggagtttctgcggagcctgctgggcagcattagctgccatgtgttgtgcctggagcacccgggcagcgccaggtttctcctgggcccagaagggcagcaccttctccaggggctggaggctcagttccagtgtgtctttgggacagagcgcctggccacagccacgttggacacaggccttgaagaggtggaccctaccgaggccctcccagtgctccctggcaacgcccacaccctgtggaccccagacagtacagaggaggtccgagaactgctggccaccctggagggcctagacctagacggggaggactggctgcctcgggagctggaggaggaagggcctcaggagcagccagaggaggaggtgaccccagggcatgaggaggaggagcctgtggcccccagcactgtggcacccaggtggctggaggaggaggccgctctgcagctggccctccaccggtcactggagcctcaaggtcaggtggctgagcaggaggaggctgctgccctgcggcaagccctaaccctctccctgctggagcagcccccgttggaggcagaagagcccccagatggggggactgatggcaaggcccagctggtggtgcactcggcctttgagcaggatgtggaggagctggaccgggcgctcagggctgccttggaggtccacgtccaggaggagacggtggggccctggcgccgcacactgcctgcagagctgcgtgctcgcctggagcggtgccatggtgtgagtgttgccctgcgtggtgactgcaccatcctccgtggcttcggggcccaccctgcccgtgctgcccgccacttggtggcacttctggctggcccctgggatcagagtttggcctttcccttggcagcttcaggccctaccttggcggggcagacgctgaaggggccctggaacaacctggagcgtctggcagagaacaccggggagttccaggaggtggtgcgggccttctacgacaccctggacgctgcccgcagcagcatccgcgtcgttcgtgtggagcgcgtgtcgcacccgctgctgcagcagcagtatgagctgtaccgggagcgcctgctgcagcgatgcgagcggcgcccggtggagcaggtgctgtaccacggcacgacggcaccggcagtgcctgacatctgcgcccacggcttcaaccgcagcttctgcggccgcaacgccacggtctacgggaagggcgtgtatttcgccaggcgcgcctccctgtcggtgcaggaccgctactcgccccccaacgccgatggccataaggcggtgttcgtggcacgggtgctgactggcgactacgggcagggccgccgcggtctgcgggcgccccctctgcggggtcctggccacgtgctcctgcgctacgacagcgccgtggactgcatctgccagcccagcatcttcgtcatcttccacgacacccaggcgctgcccacccacctcatcacctgcgagcacgtgccccgcgcttcccccgacgacccctctgggctcccgggccgctccccagacacttaaccgaaggggccaccctctggcctcctgcttcccaggctcccagctccgcacaggctgatgctccccgcccccaactgtggccgcctgagctgtccccggggacgcccctgcctccctctgcgggctccagaaggcggtgtgggggatggcggtcagcagcggccgaggggggccgggctaggtcccagcctgggccgaccccaccaccaggggtcagcagagcccaggaggcgacaccgcccgcccgccgctcccagacctcgcccgagtcggctctgttgtttgaataaacgtgaacgtgaacccaggcggaagggacccgggaactctg

SEQ ID NO: 166954 - DNA, 685 bp, Homo sapiens
  Payload ID: 12868
  Gene Symbol: PARP10
  Gene Name: poly (ADP-ribose) polymerase family, member 10
  ENST ID: ENST00000528625
  CDS Start-End: 170-685
gggggcgggggcggcaggccgcgcggcgcagcgggtcagaggcgctcctgggctcgggccggggactcaccggtggccgggcgccgcaggccgggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggtccagttgcccaagcccctttctgaggcagatgtccgtgtcctggaggagcaggcccagaatctgggcctggaggggaccttggtgtccctggcccgggttccccaggcc

SEQ ID NO: 166955 - DNA, 578 bp, Homo sapiens
  Payload ID: 12868
  Gene Symbol: PARP10
  Gene Name: poly (ADP-ribose) polymerase family, member 10
  ENST ID: ENST00000531537
  CDS Start-End: 146-578
ctttctgtggtgaggattagcggcagcaaggaatgcagtggagccattaccttgtcaccttctgagcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggtccagttgcccaagcccctttctgagg

SEQ ID NO: 166956 - DNA, 3027 bp, Homo sapiens
  Payload ID: 12868
  Gene Symbol: PARP10
  Gene Name: poly (ADP-ribose) polymerase family, member 10
  ENST ID: ENST00000527262
  CDS Start-End: 64-2358
gaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggtccagttgcccaagcccctttctgaggcagatgtccgtgtcctggaggagcaggcccagaatctgggcctggaggggaccttggtgtccctggcccgggttccccaggcccgagcggtgcgtgtggtgggggatggtgcctctgtggacctgctgttgctggagttgtacctggagaatgagcgccgcagtggtggggggcccctggaggacctgcaacgcctacccgggcccctgggcactgttgcctccttccagcagtggcaagtggcagaacgagtgttgcagcaggagcaccggttgcagggctcagagctgagccttgtcccccactacgacatcctggagcccgaggagctggctgagaacaccagtggaggggaccacccgtccacccaggggcctagggctaccaagcatgctctcctgaggaccggagggttggtgacggctctgcagggtgcagggactgtgacaatgggctctggcgaggaaccagggcagtcaggggcctctctgaggacaggtcccatggtgcagggtagagggattatgacaacaggctctggccaggaaccagggcagtcagggacctctctgaggacaggtcccatggggtctctgggacaggcagagcaagtcagctcgatgcccatggggtctctggaacatgaggggctggtaagcctgaggcctgtggggttgcaggaacaggaggggcccatgagcctggggcctgtggggtctgcaggcccagtggagacctctaaggggttgctggggcaggagggcctggtggaaattgccatggactcaccagagcaagaggggctggtgggtcccatggagatcaccatggggtctctggagaaggcagggcctgtgagcccaggatgtgtgaagctggcagggcaggagggcctggtggagatggtgctattgatggagccaggggcgatgcgcttcctgcagctctaccatgaggaccttcttgcgggcctgggagacgtcgctctcttgccacttgaaggaccggatatgactggctttcggctctgtggagcccaggcttcctgccaggcggctgaggagtttctgcggagcctgctgggcagcattagctgccatgtgttgtgcctggagcacccgggcagcgccaggtttctcctgggcccagaagggcagcaccttctccaggggctggaggctcagttccagtgtgtctttgggacagagcgcctggccacagccacgttggacacaggccttgaagaggtggaccctaccgaggccctcccagtgctccctggcaacgcccacaccctgtggaccccagacagtacaggtggtgaccaggaggacgtgagcctggaggaggtccgagaactgctggccaccctggagggcctagacctagacggggaggactggctgcctcgggagctggaggaggaagggcctcaggagcagccagaggaggaggtgaccccagggcatgaggaggaggagcctgtggcccccagcactgtggcacccaggtggctggaggaggaggccgctctgcagctggccctccaccggtcactggagcctcaaggtcaggtggctgagcaggaggaggctgctgccctgcggcaagccctaaccctctccctgctggagcagcccccgttggaggcagaagagcccccagatggggggactgatggcaaggcccagctggtggtgcactcggcctttgagcaggatgtggaggagctggaccgggcgctcagggctgccttggaggtccacgtccaggaggagacggtggggccctggcgccgcacactgcctgcagagctgcgtgctcgcctggagcggtgccatggttggcggggcagacgctgaaggggccctggaacaacctggagcgtctggcagagaacaccggggagttccaggaggtggtgcgggccttctacgacaccctggacgctgcccgcagcagcatccgcgtcgttcgtgtggagcgcgtgtcgcacccgctgctgcagcagcagtatgagctgtaccgggagcgcctgctgcagcgatgcgagcggcgcccggtggagcaggtgctgtaccacggcacgacggcaccggcagtgcctgacatctgcgcccacggcttcaaccgcagcttctgcggccgcaacgccacggtctacgggaagggcgtgtatttcgccaggcgcgcctccctgtcggtgcaggaccgctactcgccccccaacgccgatggccataaggcggtgttcgtggcacgggtgctgactggcgactacgggcagggccgccgcggtctgcgggcgccccctctgcggggtcctggccacgtgctcctgcgctacgacagcgccgtggactgcatctgccagcccagcatcttcgtcatcttccacgacacccaggcgctgcccacccacctcatcacctgcgagcacgtgccccgcgcttcccccgacgacccctctgggctcccgggccgctccccagacacttaaccgaaggggccaccctctggcctcctgcttc

SEQ ID NO: 166957 - DNA, 500 bp, Homo sapiens
  Payload ID: 12868
  Gene Symbol: PARP10
  Gene Name: poly (ADP-ribose) polymerase family, member 10
  ENST ID: ENST00000531707
  CDS Start-End: 258-500
atgctcagcacctggcaggtgtgagggaccaggagcagggttgagaaggttgctgggggcgttgaaggccagccttggccgggggcgggcctggagacccagcactttgtgtgcagagggtgtcatggacacagaggcttggagatcctgagtgaggggcagtgactcaggccccttgcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcgg

SEQ ID NO: 166958 - DNA, 589 bp, Homo sapiens
  Payload ID: 12868
  Gene Symbol: PARP10
  Gene Name: poly (ADP-ribose) polymerase family, member 10
  ENST ID: ENST00000528914
  CDS Start-End: 183-589
gcgcaactccacctgcttctgggaacccagggggaagcaagggaagaccgtgacctttgccccgggctgtggggagccccggagcctgggcccggagaagcgccagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggt

SEQ ID NO: 166959 - DNA, 529 bp, Homo sapiens
  Payload ID: 12868
  Gene Symbol: PARP10
  Gene Name: poly (ADP-ribose) polymerase family, member 10
  ENST ID: ENST00000529311
  CDS Start-End: 210-529
agtctgcttgtggtgtgagtggtgcctgtggcaggccctctgcagccagggtcggcgtaatggataacctgtgatgagttccattagagaaaacgtggaaaaagcagggatggatttacccttgtagaagcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagca

SEQ ID NO: 166960 - DNA, 3404 bp, Homo sapiens
  Payload ID: 12868
  Gene Symbol: PARP10
  Gene Name: poly (ADP-ribose) polymerase family, member 10
  ENST ID: ENST00000525773
  CDS Start-End: 190-3303
acttttgttttcctgctcccagcagggttaggcttgctgaggggcaggcacaggagtcctggctgagctcatggcctgaggctgcctagcggccacggggaatgtaagtgctgtatgtggggccacccataatgggggagcattgaggacacaccttggaggggcctggggaggggcaggaggggtggaatgggctgtttccctacccacctgatgccccgtcccagggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggtccagttgcccaagcccctttctgaggcagatgtccgtgtcctggaggagcaggcccagaatctgggcctggaggggaccttggtgtccctggcccgggttccccaggcccgagcggtgcgtgtggtgggggatggtgcctctgtggacctgctgttgctggagttgtacctggagaatgagcgccgcagtggtggggggcccctggaggacctgcaacgcctacccgggcccctgggcactgttgcctccttccagcagtggcaagtggcagaacgagtgttgcagcaggagcaccggttgcagggctcagagctgagccttgtcccccactacgacatcctggagcccgaggagctggctgagaacaccagtggaggggaccacccgtccacccaggggcctagggctaccaagcatgctctcctgaggaccggagggttggtgacggctctgcagggtgcagggactgtgacaatgggctctggcgaggaaccagggcagtcaggggcctctctgaggacaggtcccatggtgcagggtagagggattatgacaacaggctctggccaggaaccagggcagtcagggacctctctgaggacaggtcccatggggtctctgggacaggcagagcaagtcagctcgatgcccatggggtctctggaacatgaggggctggtaagcctgaggcctgtggggttgcaggaacaggaggggcccatgagcctggggcctgtggggtctgcaggcccagtggagacctctaaggggttgctggggcaggagggcctggtggaaattgccatggactcaccagagcaagaggggctggtgggtcccatggagatcaccatggggtctctggagaaggcagggcctgtgagcccaggatgtgtgaagctggcagggcaggagggcctggtggagatggtgctattgatggagccaggggcgatgcgcttcctgcagctctaccatgaggaccttcttgcgggcctgggagacgtcgctctcttgccacttgaaggaccggatatgactggctttcggctctgtggagcccaggcttcctgccaggcggctgaggagtttctgcggagcctgctgggcagcattagctgccatgtgttgtgcctggagcacccgggcagcgccaggtttctcctgggcccagaagggcagcaccttctccaggggctggaggctcagttccagtgtgtctttgggacagagcgcctggccacagccacgttggacacaggccttgaagaggtggaccctaccgaggccctcccagtgctccctggcaacgcccacaccctgtggaccccagacagtacaggtggtgaccaggaggacgtgagcctggaggaggtccgagaactgctggccaccctggagggcctagacctagacggggaggactggctgcctcgggagctggaggaggaagggcctcaggagcagccagaggaggaggtgaccccagggcatgaggaggaggagcctgtggcccccagcactgtggcacccaggtggctggaggaggaggccgctctgcagctggccctccaccggtcactggagcctcaaggtcaggtggctgagcaggaggaggctgctgccctgcggcaagccctaaccctctccctgctggagcagcccccgttggaggcagaagagcccccagatggggggactgatggcaaggcccagctggtggtgcactcggcctttgagcaggatgtggaggagctggaccgggcgctcagggctgccttggaggtccacgtccaggaggagacggtggggccctggcgccgcacactgcctgcagagctgcgtgctcgcctggagcggtgccatggtgtgagtgttgccctgcgtggtgactgcaccatcctccgtggcttcggggcccaccctgcccgtgctgcccgccacttggtggcacttctggctggcccctgggatcagagtttggcctttcccttggcagcttcaggccctaccttggcggggcagacgctgaaggggccctggaacaacctggagcgtctggcagagaacaccggggagttccaggaggtggtgcgggccttctacgacaccctggacgctgcccgcagcagcatccgcgtcgttcgtgtggagcgcgtgtcgcacccgctgctgcagcagcagtatgagctgtaccgggagcgcctgctgcagcgatgcgagcggcgcccggtggagcaggtgctgtaccacggcacgacggcaccggcagtgcctgacatctgcgcccacggcttcaaccgcagcttctgcggccgcaacgccacggtctacgggaagggcgtgtatttcgccaggcgcgcctccctgtcggtgcaggaccgctactcgccccccaacgccgatggccataaggcggtgttcgtggcacgggtgctgactggcgactacgggcagggccgccgcggtctgcgggcgccccctctgcggggtcctggccacgtgctcctgcgctacgacagcgccgtggactgcatctgccagcccagcatcttcgtcatcttccacgacacccaggcgctgcccacccacctcatcacctgcgagcacgtgccccgcgcttcccccgacgacccctctgggctcccgggccgctccccagacacttaaccgaaggggccaccctctggcctcctgcttcccaggctcccagctccgcacaggctgatgctccccgcccccaactgtggccgcctgagctgtccccgggg

SEQ ID NO: 166961 - DNA, 481 bp, Homo sapiens
  Payload ID: 12868
  Gene Symbol: PARP10
  Gene Name: poly (ADP-ribose) polymerase family, member 10
  ENST ID: ENST00000532311
  CDS Start-End: 233-481
agacaaggaacagtggaacagttggcttgacgacagcgtcgggacccagccctgcgcaactccacctgcttctgggaacccagggggaagcaagggaagaccgtgacctttgccccgggctgtggggagccccggagcctgggcccggagaagcgcggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagct

SEQ ID NO: 166962 - DNA, 564 bp, Homo sapiens
  Payload ID: 12868
  Gene Symbol: PARP10
  Gene Name: poly (ADP-ribose) polymerase family, member 10
  ENST ID: ENST00000525486
  CDS Start-End: 126-564
ctggtgctgctatgggcctgtctgcacctccgtttccctttctgtgcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggtccagttgcccaagcccctttctgaggcaggtg

SEQ ID NO: 166963 - DNA, 939 bp, Homo sapiens
  Payload ID: 12868
  Gene Symbol: PARP10
  Gene Name: poly (ADP-ribose) polymerase family, member 10
  ENST ID: ENST00000525879
  CDS Start-End: 405-939
gatttggggcttgggtcgtttctcacaagcaaccggaggcctgcgccgctgccggcgtctcccgggtgggagctcagcgcggaggctggggtctcggccggggacgtgtggggtgtgcccggaccctcccctccgcatcccgccccttaagcagctttaaggggccggagccggcggctatttctatcccaggaaatccccgggccatctgtgaccaacaaaggcccgagcccccccacccccgcgagcccaacaacagggcccaacggcccctggctccggggtggggggatcgggcctggatcggctgccggtgcctgccagtgggggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggtccagttgcccaagcccctttctgaggcagatgtccgtgtcctggaggagcaggcccagaatctgggcctggaggggaccttggtgtccctggcccgggttccccaggcccgagcggtgcgtgtggtgg

SEQ ID NO: 166964 - DNA, 588 bp, Homo sapiens
  Payload ID: 12868
  Gene Symbol: PARP10
  Gene Name: poly (ADP-ribose) polymerase family, member 10
  ENST ID: ENST00000530478
  CDS Start-End: 323-588
cagtccccacttccctcctcactctcttgggagcgaggcctcttaccattgttctggcgtgaggaaaggcctgctgttgcctcaccaagcccactcgtgaacccgctgatgccgagcccgcctgcctgagtcttgatcgctgacttgagctcgtgattctcccgaatgagccgcaccaacttcttcagttcctcattttcccgcaccagcctctctatctgatgccgaagcccttcataattgcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgc

SEQ ID NO: 166965 - DNA, 696 bp, Homo sapiens
  Payload ID: 12868
  Gene Symbol: PARP10
  Gene Name: poly (ADP-ribose) polymerase family, member 10
  ENST ID: ENST00000529842
  CDS Start-End: 265-696
attaccttgtcaccttctgaggttacttgtgacgatgccaatgatggtgtgagatggggaggtgcaggcaggacagaaagctgcaggaatgggcaggcaagacctgaggcgggaggaaggctgtgctgcaatgcacattcttggagaccaagggtggggaaccgcccatgctcagcacctggcagcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggtccagttgcccaagcccctttctgag

SEQ ID NO: 166966 - DNA, 4424 bp, Homo sapiens
  Payload ID: 12869
  Gene Symbol: PARP11
  Gene Name: poly (ADP-ribose) polymerase family, member 11
  Uniprot ID: Q9NR21
  ENST ID: ENST00000228820
  CDS Start-End: 146-1162
gggagggggaggaggaaggccttcgtaaaggttgcatctccgtcccttcgctcccggggacccgcgggaaaaaaaaaaatccaacacccaggccccgcggctagccccttcccacaggctctctccgctcgattttgtcaccgttatgtgggaagcgaatccagagatgtttcacaaagcagaagaattattttctaaaacaacaaacaatgaagtggatgacatggacacgtcagatacccagtggggctggttttacttggcagaatgtgggaagtggcacatgtttcagccggataccaacagtcagtgttcagttagcagtgaagatatcgaaaaaagcttcaaaacaaacccttgtggctccatttcttttactacttccaaattcagctacaagatagactttgcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcaggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaaggaacctattttgctagagatgctgcttattccagtcgtttctgcaaagatgacataaagcatgggaacacattccaaattcatggtgtcagcttgcaacagcggcatctgtttagaacatataaatctatgtttcttgctcgagtgctaattggagattacataaacggagactccaaatacatgcgacctccttccaaagacgggagctatgtgaatttatatgacagctgtgtggatgatacctggaacccaaagatctttgtggtttttgatgccaaccaaatctatcctgagtacttgatagactttcattgatttcacttccaaatctcggtggtcaaggaagctttattcttttttgcaggaaggtttgctcttcagtcatctagccactaaatgttaattatctgatacttttgaaacagatatgaaaaaaagtggcctccatataaaaagacatactgacttcaaggttggtttttgttgttttgtttttgcctgtttcttgtagtcttgtttgttaaaagttgatatcattgatgttttaacacataggggtgaaagataccattcaaaatggaatcagctgagtctcaactaatgtggtcattgagatctttaaagtttacgtgtgtgttatcaggataaatgattttagtttaaatagacttattcgtataaatgttgaaaaaaaatacagacataaatgtgtccctttagaggaattgatcctttgtaaattgaattcaggtagtagtatcatccaccaatccatctgttgctttgttggtcttctgaaggggggatttaaaactctgaaacagtctgagcaccttgagagaaatcagaaacaagacaattatttgcagtgctgtcaaacaagccagaaggagaaaatcaaggtagaatgccccactttccagttgccttaggatagcaggctgcagcctcagacttgatcctgtcattctcctctgtctcccacatctgaattgataattgctgcaaaatgtcattagcctacacttcatccatcagggctcttggattcttacaccacgacttgctgtgcaaggtgtttattgcatcttcaaagtgaaactttaaattattattcaaacatttattttccttttgttttaaaaagagtccctacaatgatcacttctaagatttttttttaccttcccctctgcagcacacacagctattcaacaatgatttctaaaattcatatttcaaatttgtatctctccattttgaaacattatagaaagcatgggatgcttgagacaaatctggtttctcctttgaagtagctgttgacaacctactctcttgaaaagttagatataattcttaatcatgtttagtggaaatttgtttacctgttccatctgttttgctgtttcattgtaaggaagatgagaagtgttggaacagcttccctcccctaaaggtattctagcagaggcgagacagcaacttggcgggcatgttgcataggagttaagtaccagatggggaattgcccatgtgatggtgaagagtctctcacattgattttcttccttttctcctcttctctcctccttctcttctctcctctttctcttctcttctttctcttctcttctgtcttcctcttcctcttctcttcctctcctcttcctctttctctctcttcctttttctcttcctctttctctttctctttctcttctcttctctctctcttccttccttctttctttccttccttccttccttccttccttccttccttccttctttccctccctccctccctccctcctccctttttctttttctttctttttttttggtttggcagagtcttgctctgttgcccaggctgcagtgcagtggtgtgatctcggctcactgcaacctccacctcccgggttcaagcaattctcttgcctcagcttctccagttactgggactacaggtgcataccaccatgcccggctaatttttgtatttttagtagaggcggggttttgtcatgttggccaggctgatctcaaactcctgacctcaggtgatccgcctgcctcagccttccaaagtgctgagattacaggcatgagccgctgtacccggcctgattttctatgattctgcctttaaaagacagcacgtataccaagcctttttcagaaagcttttctcttaactccttctaatgctgaattttctctctattatcctcacccaattttggctgagagttagtgtacacaatttaacttcttagaaaaattccagtgtctatgcttatattgctcacttgaatcatttgaattagaaagggatctacaaataataaaagcaaagagtgcagacagattagggatagtaattcttaaagtgccatctatcccagatttccgttatagaccagcatatgtgtaattgtgcagtgggaggtaagtagtacccaggacattgcatgtacaatactttgaaacaaagtggcaacaaagatttcctggctcaggtatgcaccccagctgctggtttagatgaagtgctgagaatatttagaaaaagcgctttaaaaagcatctagagattatcatgaaaataattggagacaaagtcactaggctgctttgtgagaggcagcataccatggctctaaacccgttcacaaaaaacaatgttagagacattaggaattcaggttttgaaaatctttttttcgatttatttgtaatttacataccaaaaaaccacattaaaatagtcctcccttcaacatggctatcttttttcaagttttatatgcatagctctctcagcacttgaatggaaaaactgttacagcatttgggagttgtttttcttttagactttgcagatcttatctcaaggtgactaggaacccagagctaagtatctgtgaggcaatctctgcgaacgctgaacttacctagttggtttctatgaaatatgtagaatgcactgcagtagccattgtaagaaggtactataccggttttttggggcttgttgttgttgtttggtctgagaatgtactgccaacccctcttttataagagagaactgattttgatacatattttaaaatatgatagtacagagttaatggatgttaaaattttatttctttgttttggtaagtagattaaatcgagaatcatataatcagtacatttgagaattatataaccagtatataataatactggacacaaccatttgccatcttttcctgttatcatcccatagagtgggtggggagaatgaatagacataaacctagaataatgataaatggtttttaaaactctatattgaatacattccagctgataatgacttttctttttcaccttggtgatatcagcctcagggtaaaaaaaaaagtttcataaatcttttagttataaacaggaaagttttatattagtgtgtcatttcatttctagactgttgatggtgatgatgataaagaatttggagccaattttgatatatgaatgtattgcttttacatgtgatgattaaagctctccattagcagtt

SEQ ID NO: 166967 - DNA, 539 bp, Homo sapiens
  Payload ID: 12869
  Gene Symbol: PARP11
  Gene Name: poly (ADP-ribose) polymerase family, member 11
  ENST ID: ENST00000450737
  CDS Start-End: 400-539
agatctgactggccaacgtcgggcggaagtcgggaggttgggtggtctgtaaacgctggcttgtgacagggagggggaggaggaaggccttcgtaaaggttgcatctccgtcccttcgctcccggggacccgcgggaaaaaaaaaaatccaacacccaggccccgcggctagccccttcccacaggctctctccgctcgattttgtcaccgttatgtgggaagcgaatccatgtatttgcatgcccgagtctttgagccgtgctataccagtttgtccagattgtttatactagcaatgcagtttacggtgaagacctgccttccctctgggaatctggagcttcagtaacaggagatgtttcacaaagcagaagaattattttctaaaacaacaaacaatgaagtggatgacatggacacgtcagatacccagtggggctggttttacttggcagaatgtgggaagtggcacatgtttcagccggataccaacagtcagtgttcagttagcagtgaagatatcgaaaaaagcttcaaa

SEQ ID NO: 166968 - DNA, 2428 bp, Homo sapiens
  Payload ID: 12869
  Gene Symbol: PARP11
  Gene Name: poly (ADP-ribose) polymerase family, member 11
  ENST ID: ENST00000416739
  CDS Start-End: 208-927
gactggccaacgtcgggcggaagtcgggaggttgggtggtctgtaaacgctggcttgtgacagggagggggaggaggaaggccttcgtaaaggttgcatctccgtcccttcgctcccggggacccgcgggaaaaaaaaaaatccaacacccaggccccgcggctagccccttcccacaggctctctccgctcgattttgtcaccgttatgtgggaagcgaatccagagatgtttcacaaagcagaagaattattttctaaaacaacaaacaatgaagtggatgacatggacacgtcagatacccagtggggctggttttacttggcagaatgtgggaagtggcacatgtttcagccggataccaacagtcagtgttcagttagcagtgaagatatcgaaaaaagcttcaaaacaaacccttgtggctccatttcttttactacttccaaattcagctacaagatagactttgcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcaggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaagataacatgtggaagctgtaggcattataagcccacgtttgatgaacagtctcagagaatcagcgtgcaagctcatttcctccactttattcctataagaagaagatcaagcctcaacttgggagccagctgatctgaattttattcctggctttgctgtctgattcagtgtgaccttggataactcaccagagagggaaggttcacttttcagaaggttaagtgcatggaaagaacctctgatggaaatcaaggagtactgacagcacgatgtggaaaataagagagaaaagaaaaaaaggaagatggaaattctgacaaggaaattaagatgcatgtccatggatgttttttgttttgatgatagcaaaagagtgatatatttgcataacaatatgaggacactgaggcaactcccctcaccccagggcacatagctaggaagtggcaaagccaatctggctggagtaccctgtactagccactctgctactctgctgcttttaagtctgtattaatggcaagcacgcgcgcacgcgcacacacacaactcctttatccttgccatcgtctttcaaagataagaatcaaagaccaaagcgtccttagatgttgtatcagagttcaagcaagggacagaaatcaccgcagaaatttggacagggaaaatttaatataaagaattgttgactatgtaaagttctgttaactactgaaaggggaaaaagaactctaagaagcagcaaggcagttaactgcagaaagtggcttctacacctaagactaagggaaaaatgaacaaggaaggaacttacaaactattggaaaaggtccctgcaaggctggattcagacctctgaggagagttcctggttgttacaggaacatgctgcctgtagtcctggtgccaaggaaacttgctgaagggtacccgctgttaaactgcatagggcagcctgccactgctgtaaaccctgaccgggataaccgcgtgccgatctgcctgccactatatgggaaaacagaaaactagatgaagaagaaaaaggcctctgtcttccagccatgcattgttccttccacactccttattgtcaaagcctaacatggagccagctggcaaaggaaaagtgtggcctgtagagttcagccccagtattacaaagcaggatgaagaaactgggattggagctgaaagacaataaattaataactgatacagatggaaagtacatttttcaacccaaggatagaaagaagccccaaacatcatcacacaaaaggaagacagattggctgagagaggcatttacattaaaaaaataaaatactgaaggtttacagggacacatctcttggagtagagcagcctacctccaaggtattggataagcaagacaaggtgttataaagcctattgtgtaaatatatacagaagactgagaggttttcaaccgaataaatgaatgcctggtacagcgttaatatagctgagaaattcatcctgtaacaagttgagtca

SEQ ID NO: 166969 - DNA, 1197 bp, Homo sapiens
  Payload ID: 12869
  Gene Symbol: PARP11
  Gene Name: poly (ADP-ribose) polymerase family, member 11
  ENST ID: ENST00000453942
  CDS Start-End: 122-679
gtaaaggttgcatctccgtcccttcgctcccggggacccgcgggaaaaaaaaaaatccaacacccaggccccgcggctagccccttcccacaggctctctccgctcgattttgtcaccgttatgtgggaagcgaatccagagatgtttcacaaagcagaagaattattttctaaaacaacaaacaatgaagtggatgacatggacacgtcagatacccagtggggctggttttacttggcagaatgtgggaagtggcacatgtttcagccggataccaacagtcagtgttcagttagcagtgaagatatcgaaaaaagcttcaaaacaaacccttgtggctccatttcttttactacttccaaattcagctacaagatagactttgcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcagatacaggtgaagtgtttactccatccctgtcctactctccttctttcctcctgagattggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaaggaacctattttgctagagatgctgcttattccagtcgtttctgcaaagatgacataaagcatgggaacacattccaaattcatggtgtcagcttgcaacagcggcatctgtttagaacatataaatctatgtttcttgctcgagtgctaattggagattacataaacggagactccaaatacatgcgacctccttccaaagacgggagctatgtgaatttatatgacagctgtgtggatgatacctggaacccaaagatctttgtggtttttgatgccaaccaaatctatcctgagtacttgatagactttcattga

SEQ ID NO: 166970 - DNA, 4406 bp, Homo sapiens
  Payload ID: 12869
  Gene Symbol: PARP11
  Gene Name: poly (ADP-ribose) polymerase family, member 11
  Uniprot ID: Q9NR21
  ENST ID: ENST00000427057
  CDS Start-End: 371-1144
ccttcgtaaaggttgcatctccgtcccttcgctcccggggacccgcgggaaaaaaaaaaatccaacacccaggccccgcggctagccccttcccacaggctctctccgctcgattttgtcaccgttatgtgggaagcgaatccatgtatttgcatgcccgagtctttgagccgtgctataccagtttgtccagattgtttatactagcaatgcagtttacggtgaagacctgccttccctctgggaatctggagcttcagtaacaggagatgtttcacaaagcagaagaattattttctaaaacaacaaacaatgaagtggatgacatggacacgtcagatacccagtggggctggttttacttggcagaatgtgggaagtggcacatgtttcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcaggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaaggaacctattttgctagagatgctgcttattccagtcgtttctgcaaagatgacataaagcatgggaacacattccaaattcatggtgtcagcttgcaacagcggcatctgtttagaacatataaatctatgtttcttgctcgagtgctaattggagattacataaacggagactccaaatacatgcgacctccttccaaagacgggagctatgtgaatttatatgacagctgtgtggatgatacctggaacccaaagatctttgtggtttttgatgccaaccaaatctatcctgagtacttgatagactttcattgatttcacttccaaatctcggtggtcaaggaagctttattcttttttgcaggaaggtttgctcttcagtcatctagccactaaatgttaattatctgatacttttgaaacagatatgaaaaaaagtggcctccatataaaaagacatactgacttcaaggttggtttttgttgttttgtttttgcctgtttcttgtagtcttgtttgttaaaagttgatatcattgatgttttaacacataggggtgaaagataccattcaaaatggaatcagctgagtctcaactaatgtggtcattgagatctttaaagtttacgtgtgtgttatcaggataaatgattttagtttaaatagacttattcgtataaatgttgaaaaaaaatacagacataaatgtgtccctttagaggaattgatcctttgtaaattgaattcaggtagtagtatcatccaccaatccatctgttgctttgttggtcttctgaaggggggatttaaaactctgaaacagtctgagcaccttgagagaaatcagaaacaagacaattatttgcagtgctgtcaaacaagccagaaggagaaaatcaaggtagaatgccccactttccagttgccttaggatagcaggctgcagcctcagacttgatcctgtcattctcctctgtctcccacatctgaattgataattgctgcaaaatgtcattagcctacacttcatccatcagggctcttggattcttacaccacgacttgctgtgcaaggtgtttattgcatcttcaaagtgaaactttaaattattattcaaacatttattttccttttgttttaaaaagagtccctacaatgatcacttctaagatttttttttaccttcccctctgcagcacacacagctattcaacaatgatttctaaaattcatatttcaaatttgtatctctccattttgaaacattatagaaagcatgggatgcttgagacaaatctggtttctcctttgaagtagctgttgacaacctactctcttgaaaagttagatataattcttaatcatgtttagtggaaatttgtttacctgttccatctgttttgctgtttcattgtaaggaagatgagaagtgttggaacagcttccctcccctaaaggtattctagcagaggcgagacagcaacttggcgggcatgttgcataggagttaagtaccagatggggaattgcccatgtgatggtgaagagtctctcacattgattttcttccttttctcctcttctctcctccttctcttctctcctctttctcttctcttctttctcttctcttctgtcttcctcttcctcttctcttcctctcctcttcctctttctctctcttcctttttctcttcctctttctctttctctttctcttctcttctctctctcttccttccttctttctttccttccttccttccttccttccttccttccttccttctttccctccctccctccctccctcctccctttttctttttctttctttttttttggtttggcagagtcttgctctgttgcccaggctgcagtgcagtggtgtgatctcggctcactgcaacctccacctcccgggttcaagcaattctcttgcctcagcttctccagttactgggactacaggtgcataccaccatgcccggctaatttttgtatttttagtagaggcggggttttgtcatgttggccaggctgatctcaaactcctgacctcaggtgatccgcctgcctcagccttccaaagtgctgagattacaggcatgagccgctgtacccggcctgattttctatgattctgcctttaaaagacagcacgtataccaagcctttttcagaaagcttttctcttaactccttctaatgctgaattttctctctattatcctcacccaattttggctgagagttagtgtacacaatttaacttcttagaaaaattccagtgtctatgcttatattgctcacttgaatcatttgaattagaaagggatctacaaataataaaagcaaagagtgcagacagattagggatagtaattcttaaagtgccatctatcccagatttccgttatagaccagcatatgtgtaattgtgcagtgggaggtaagtagtacccaggacattgcatgtacaatactttgaaacaaagtggcaacaaagatttcctggctcaggtatgcaccccagctgctggtttagatgaagtgctgagaatatttagaaaaagcgctttaaaaagcatctagagattatcatgaaaataattggagacaaagtcactaggctgctttgtgagaggcagcataccatggctctaaacccgttcacaaaaaacaatgttagagacattaggaattcaggttttgaaaatctttttttcgatttatttgtaatttacataccaaaaaaccacattaaaatagtcctcccttcaacatggctatcttttttcaagttttatatgcatagctctctcagcacttgaatggaaaaactgttacagcatttgggagttgtttttcttttagactttgcagatcttatctcaaggtgactaggaacccagagctaagtatctgtgaggcaatctctgcgaacgctgaacttacctagttggtttctatgaaatatgtagaatgcactgcagtagccattgtaagaaggtactataccggttttttggggcttgttgttgttgtttggtctgagaatgtactgccaacccctcttttataagagagaactgattttgatacatattttaaaatatgatagtacagagttaatggatgttaaaattttatttctttgttttggtaagtagattaaatcgagaatcatataatcagtacatttgagaattatataaccagtatataataatactggacacaaccatttgccatcttttcctgttatcatcccatagagtgggtggggagaatgaatagacataaacctagaataatgataaatggtttttaaaactctatattgaatacattccagctgataatgacttttctttttcaccttggtgatatcagcctcagggtaaaaaaaaaagtttcataaatcttttagttataaacaggaaagttttatattagtgtgtcatttcatttctagactgttgatggtgatgatgataaagaatttggagccaattttgatatatgaatgtattgcttttacatgtgatgattaaagctctccattagcagtt

SEQ ID NO: 166971 - DNA, 4299 bp, Homo sapiens
  Payload ID: 12869
  Gene Symbol: PARP11
  Gene Name: poly (ADP-ribose) polymerase family, member 11
  ENST ID: ENST00000458162
  CDS Start-End: 142-294
gggggaggaggaaggccttcgtaaaggttgcatctccgtcccttcgctcccggggacccgcgggaaaaaaaaaaatccaacacccaggccccgcggctagccccttcccacaggctctctccgctcgattttgtcaccgttatgtgggaagcgaatccagagatgtttcacaaagcagaagaattattttctaaaacaacaaacaatgaagtggatgacatggacacgtcagatacccagtggggctggttttacttggcagaatgtgggaagtggcacatgtttcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcaggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaaggaacctattttgctagagatgctgcttattccagtcgtttctgcaaagatgacataaagcatgggaacacattccaaattcatggtgtcagcttgcaacagcggcatctgtttagaacatataaatctatgtttcttgctcgagtgctaattggagattacataaacggagactccaaatacatgcgacctccttccaaagacgggagctatgtgaatttatatgacagctgtgtggatgatacctggaacccaaagatctttgtggtttttgatgccaaccaaatctatcctgagtacttgatagactttcattgatttcacttccaaatctcggtggtcaaggaagctttattcttttttgcaggaaggtttgctcttcagtcatctagccactaaatgttaattatctgatacttttgaaacagatatgaaaaaaagtggcctccatataaaaagacatactgacttcaaggttggtttttgttgttttgtttttgcctgtttcttgtagtcttgtttgttaaaagttgatatcattgatgttttaacacataggggtgaaagataccattcaaaatggaatcagctgagtctcaactaatgtggtcattgagatctttaaagtttacgtgtgtgttatcaggataaatgattttagtttaaatagacttattcgtataaatgttgaaaaaaaatacagacataaatgtgtccctttagaggaattgatcctttgtaaattgaattcaggtagtagtatcatccaccaatccatctgttgctttgttggtcttctgaaggggggatttaaaactctgaaacagtctgagcaccttgagagaaatcagaaacaagacaattatttgcagtgctgtcaaacaagccagaaggagaaaatcaaggtagaatgccccactttccagttgccttaggatagcaggctgcagcctcagacttgatcctgtcattctcctctgtctcccacatctgaattgataattgctgcaaaatgtcattagcctacacttcatccatcagggctcttggattcttacaccacgacttgctgtgcaaggtgtttattgcatcttcaaagtgaaactttaaattattattcaaacatttattttccttttgttttaaaaagagtccctacaatgatcacttctaagatttttttttaccttcccctctgcagcacacacagctattcaacaatgatttctaaaattcatatttcaaatttgtatctctccattttgaaacattatagaaagcatgggatgcttgagacaaatctggtttctcctttgaagtagctgttgacaacctactctcttgaaaagttagatataattcttaatcatgtttagtggaaatttgtttacctgttccatctgttttgctgtttcattgtaaggaagatgagaagtgttggaacagcttccctcccctaaaggtattctagcagaggcgagacagcaacttggcgggcatgttgcataggagttaagtaccagatggggaattgcccatgtgatggtgaagagtctctcacattgattttcttccttttctcctcttctctcctccttctcttctctcctctttctcttctcttctttctcttctcttctgtcttcctcttcctcttctcttcctctcctcttcctctttctctctcttcctttttctcttcctctttctctttctctttctcttctcttctctctctcttccttccttctttctttccttccttccttccttccttccttccttccttccttctttccctccctccctccctccctcctccctttttctttttctttctttttttttggtttggcagagtcttgctctgttgcccaggctgcagtgcagtggtgtgatctcggctcactgcaacctccacctcccgggttcaagcaattctcttgcctcagcttctccagttactgggactacaggtgcataccaccatgcccggctaatttttgtatttttagtagaggcggggttttgtcatgttggccaggctgatctcaaactcctgacctcaggtgatccgcctgcctcagccttccaaagtgctgagattacaggcatgagccgctgtacccggcctgattttctatgattctgcctttaaaagacagcacgtataccaagcctttttcagaaagcttttctcttaactccttctaatgctgaattttctctctattatcctcacccaattttggctgagagttagtgtacacaatttaacttcttagaaaaattccagtgtctatgcttatattgctcacttgaatcatttgaattagaaagggatctacaaataataaaagcaaagagtgcagacagattagggatagtaattcttaaagtgccatctatcccagatttccgttatagaccagcatatgtgtaattgtgcagtgggaggtaagtagtacccaggacattgcatgtacaatactttgaaacaaagtggcaacaaagatttcctggctcaggtatgcaccccagctgctggtttagatgaagtgctgagaatatttagaaaaagcgctttaaaaagcatctagagattatcatgaaaataattggagacaaagtcactaggctgctttgtgagaggcagcataccatggctctaaacccgttcacaaaaaacaatgttagagacattaggaattcaggttttgaaaatctttttttcgatttatttgtaatttacataccaaaaaaccacattaaaatagtcctcccttcaacatggctatcttttttcaagttttatatgcatagctctctcagcacttgaatggaaaaactgttacagcatttgggagttgtttttcttttagactttgcagatcttatctcaaggtgactaggaacccagagctaagtatctgtgaggcaatctctgcgaacgctgaacttacctagttggtttctatgaaatatgtagaatgcactgcagtagccattgtaagaaggtactataccggttttttggggcttgttgttgttgtttggtctgagaatgtactgccaacccctcttttataagagagaactgattttgatacatattttaaaatatgatagtacagagttaatggatgttaaaattttatttctttgttttggtaagtagattaaatcgagaatcatataatcagtacatttgagaattatataaccagtatataataatactggacacaaccatttgccatcttttcctgttatcatcccatagagtgggtggggagaatgaatagacataaacctagaataatgataaatggtttttaaaactctatattgaatacattccagctgataatgacttttctttttcaccttggtgatatcagcctcagggtaaaaaaaaaagtttcataaatcttttagttataaacaggaaagttttatattagtgtgtcatttcatttctagactgttgatggtgatgatgataaagaatttggagccaattttgatatatgaatgtattgcttttacatgtgatgattaaagctctccattagcagtt

SEQ ID NO: 166972 - DNA, 4377 bp, Homo sapiens
  Payload ID: 12869
  Gene Symbol: PARP11
  Gene Name: poly (ADP-ribose) polymerase family, member 11
  Uniprot ID: Q9NR21
  ENST ID: ENST00000447133
  CDS Start-End: 342-1115
ggagacagatctgactggccaacgtcgggcggaagtcgggaggttgggtggtctgtaaacgctggcttgtgacagggagggggaggaggaaggccttcgtaaaggttgcatctccgtcccttcgctcccggggacccgcgggaaaaaaaaaaatccaacacccaggccccgcggctagccccttcccacaggctctctccgctcgattttgtcaccgttatgtgggaagcgaatccagagatgtttcacaaagcagaagaattattttctaaaacaacaaacaatgaagtggatgacatggacacgtcagatacccagtggggctggttttacttggcagaatgtgggaagtggcacatgtttcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcaggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaaggaacctattttgctagagatgctgcttattccagtcgtttctgcaaagatgacataaagcatgggaacacattccaaattcatggtgtcagcttgcaacagcggcatctgtttagaacatataaatctatgtttcttgctcgagtgctaattggagattacataaacggagactccaaatacatgcgacctccttccaaagacgggagctatgtgaatttatatgacagctgtgtggatgatacctggaacccaaagatctttgtggtttttgatgccaaccaaatctatcctgagtacttgatagactttcattgatttcacttccaaatctcggtggtcaaggaagctttattcttttttgcaggaaggtttgctcttcagtcatctagccactaaatgttaattatctgatacttttgaaacagatatgaaaaaaagtggcctccatataaaaagacatactgacttcaaggttggtttttgttgttttgtttttgcctgtttcttgtagtcttgtttgttaaaagttgatatcattgatgttttaacacataggggtgaaagataccattcaaaatggaatcagctgagtctcaactaatgtggtcattgagatctttaaagtttacgtgtgtgttatcaggataaatgattttagtttaaatagacttattcgtataaatgttgaaaaaaaatacagacataaatgtgtccctttagaggaattgatcctttgtaaattgaattcaggtagtagtatcatccaccaatccatctgttgctttgttggtcttctgaaggggggatttaaaactctgaaacagtctgagcaccttgagagaaatcagaaacaagacaattatttgcagtgctgtcaaacaagccagaaggagaaaatcaaggtagaatgccccactttccagttgccttaggatagcaggctgcagcctcagacttgatcctgtcattctcctctgtctcccacatctgaattgataattgctgcaaaatgtcattagcctacacttcatccatcagggctcttggattcttacaccacgacttgctgtgcaaggtgtttattgcatcttcaaagtgaaactttaaattattattcaaacatttattttccttttgttttaaaaagagtccctacaatgatcacttctaagatttttttttaccttcccctctgcagcacacacagctattcaacaatgatttctaaaattcatatttcaaatttgtatctctccattttgaaacattatagaaagcatgggatgcttgagacaaatctggtttctcctttgaagtagctgttgacaacctactctcttgaaaagttagatataattcttaatcatgtttagtggaaatttgtttacctgttccatctgttttgctgtttcattgtaaggaagatgagaagtgttggaacagcttccctcccctaaaggtattctagcagaggcgagacagcaacttggcgggcatgttgcataggagttaagtaccagatggggaattgcccatgtgatggtgaagagtctctcacattgattttcttccttttctcctcttctctcctccttctcttctctcctctttctcttctcttctttctcttctcttctgtcttcctcttcctcttctcttcctctcctcttcctctttctctctcttcctttttctcttcctctttctctttctctttctcttctcttctctctctcttccttccttctttctttccttccttccttccttccttccttccttccttccttctttccctccctccctccctccctcctccctttttctttttctttctttttttttggtttggcagagtcttgctctgttgcccaggctgcagtgcagtggtgtgatctcggctcactgcaacctccacctcccgggttcaagcaattctcttgcctcagcttctccagttactgggactacaggtgcataccaccatgcccggctaatttttgtatttttagtagaggcggggttttgtcatgttggccaggctgatctcaaactcctgacctcaggtgatccgcctgcctcagccttccaaagtgctgagattacaggcatgagccgctgtacccggcctgattttctatgattctgcctttaaaagacagcacgtataccaagcctttttcagaaagcttttctcttaactccttctaatgctgaattttctctctattatcctcacccaattttggctgagagttagtgtacacaatttaacttcttagaaaaattccagtgtctatgcttatattgctcacttgaatcatttgaattagaaagggatctacaaataataaaagcaaagagtgcagacagattagggatagtaattcttaaagtgccatctatcccagatttccgttatagaccagcatatgtgtaattgtgcagtgggaggtaagtagtacccaggacattgcatgtacaatactttgaaacaaagtggcaacaaagatttcctggctcaggtatgcaccccagctgctggtttagatgaagtgctgagaatatttagaaaaagcgctttaaaaagcatctagagattatcatgaaaataattggagacaaagtcactaggctgctttgtgagaggcagcataccatggctctaaacccgttcacaaaaaacaatgttagagacattaggaattcaggttttgaaaatctttttttcgatttatttgtaatttacataccaaaaaaccacattaaaatagtcctcccttcaacatggctatcttttttcaagttttatatgcatagctctctcagcacttgaatggaaaaactgttacagcatttgggagttgtttttcttttagactttgcagatcttatctcaaggtgactaggaacccagagctaagtatctgtgaggcaatctctgcgaacgctgaacttacctagttggtttctatgaaatatgtagaatgcactgcagtagccattgtaagaaggtactataccggttttttggggcttgttgttgttgtttggtctgagaatgtactgccaacccctcttttataagagagaactgattttgatacatattttaaaatatgatagtacagagttaatggatgttaaaattttatttctttgttttggtaagtagattaaatcgagaatcatataatcagtacatttgagaattatataaccagtatataataatactggacacaaccatttgccatcttttcctgttatcatcccatagagtgggtggggagaatgaatagacataaacctagaataatgataaatggtttttaaaactctatattgaatacattccagctgataatgacttttctttttcaccttggtgatatcagcctcagggtaaaaaaaaaagtttcataaatcttttagttataaacaggaaagttttatattagtgtgtcatttcatttctagactgttgatggtgatgatgataaagaatttggagccaattttgatatatgaatgtattgcttttacatgtgatgattaaagctctccattagcagtt

SEQ ID NO: 166973 - DNA, 3796 bp, Homo sapiens
  Payload ID: 12870
  Gene Symbol: PARP12
  Gene Name: poly (ADP-ribose) polymerase family, member 12
  Uniprot ID: Q9H0J9
  ENST ID: ENST00000263549
  CDS Start-End: 875-2980
attcctggattacctcctcaaagggctctaacaactcgcattgctctcagcgtgtgagagggtcctttgctctgaagggtcttctaaaatatttgttcaatcgttacttagcaggggctgggagtaacggattttattttattttattttattttttgagacggagtctcgctctgtcgcccaggctggagtgcagtcgcgcaatctcggctcacggatttgctcttttaaaggacatacccttttatgtttaaatgaaggaactcattgatgcaccgaggcgaaaggaacctttaattaagtgcgtcttctatgcggagtgatcgcttttgtcacttgttcgaggggtgagagctcccgtcagttgtccctgtttctgtgagccgtctacgaagcccgggcttggcctgggcgacgctgagcggctttaaccggcggcgtccagccggctccgccagcgctgccgccgccctcgaggctccctctgactgaaggcgcgctgagcatcgcggcattaggggctcctggtccctcaaacatccagggaagccattttcagggactaggtactgacccccgcgagccgccacagccacagcccgcgctccgggccgaacgcccgagctcaagagctcccgagcttccgtcgggcggcggcctcacagctgggggccctgaggcggaaggcgcagccgctcagctgcggaccgggggcgtggcgagggcgcacaggttctgtttttcgccggcccggggccgctttcggtttcgtttcccgccggcgtctccaccctgcgagagccgcccgccagccagcgtccgccgccgtccgcgtcgcgccacccgcggtccgacgggagcaggcccagcggccatggcccaggccggcgtcgtcggtgaggtcacccaggtgctgtgcgcggccgggggcgccctggagttgcccgagctgcggcgccgcttgcggatgggcttgagcgccgacgcgctggagcggctgctgcggcagcgtgggcgcttcgtggtggcggtgcgggcgggcggcgcagccgcggccccggagcgcgtggtgctggccgcctcgccgctgcgcctgtgtcgcgcgcaccagggctccaagccgggctgcgtggggctctgcgcgcagctccacctctgcaggttcatggtctacggcgcctgcaagttcctgagagccgggaagaactgtaggaatagtcacagcttgacaaccgaacacaacctgagtgtgctgagaactcatggcgttgaccacctgagctataatgagctatgccaactcttgtttcagaacgacccctggcttttgccagaaatttgccaacattacaacaaaggagatggaccccacggctcttgtgcctttcaaaagcagtgcatcaagctccatatctgccagtattttttacagggggaatgcaagtttggcactagctgtaagagatcccatgatttctctaattctgagaatctggaaaaattggagaagttgggtatgagctcagacctggtgagcaggctgcctaccatttatagaaatgcacatgacatcaagaataagagctctgcccccagcagagtgcctcctctttttgtcccacaggggacttctgaaagaaaagacagttcaggttctgtgtccccaaacactcttagccaggaggagggtgatcagatctgtttgtaccatatccggaaaagttgtagctttcaagataagtgccatagagttcatttccatttgccgtatcgatggcaattcttggatagaggcaaatgggaggatttggacaacatggaacttattgaagaggcatattgcaatcccaaaatagaaaggatcctgtgctctgagtcagccagtacctttcactctcattgtctgaactttaacgccatgacttacggtgctacccaggctcgccgcctctccacggcctcctctgtcaccaaacctccacacttcatcctcaccactgactggatttggtactggagtgatgagtttggttcttggcaggaatatggaagacagggcacggtgcaccctgtgaccactgtcagcagtagcgacgtggagaaggcctacctggcctactgtacaccggggtctgacggccaggcagccaccttgaagttccaggccggaaagcacaactacgagttagatttcaaagccttcgttcagaaaaacctggtctatggcacaactaaaaaggtttgccgcagacccaaatacgtgtctccccaggatgtgacgaccatgcaaacctgcaataccaagtttccaggcccgaagagcatcccagactattgggactcctctgccctgccagacccaggctttcagaagatcacccttagttcttcctcggaagagtatcagaaggtctggaacctctttaaccgcacgctgcctttctactttgttcagaagattgagcgagtacagaacctggccctctgggaagtctaccagtggcaaaaaggacagatgcagaagcagaacggagggaaggccgtggacgagcggcagctgttccacggcaccagcgccatttttgtggacgccatctgccagcagaactttgactggcgggtctgtggtgttcatggcacttcctacggcaaggggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatctttgagaaacaccaggtctacccagagtatgtcatccagtacaccacctcctccaagccctcggtcacaccctccatcctgctggccttgggctccctgttcagcagccgacagtgagcgcacaggagtgttccaggcctttcacctgctctgccttgaaatggctatttgggcctttccttttctttttaaacagaaacttttaatgaactgttctcttaacattgacctctcaatgaagttatgttcttaatctcttgctaataatgatttttacttttaagtcacttttgggttcactagtggattaaccagaagtgattgtagttgagtccagttttgctttttaataatgtgttgaagttttagtttttactctttgttgactttgctgcttattggcaccagggacagagtttctagatacaattttatggattggttttaatttttatgagtttgtctctgcagtgattcggtttctcagagtctcatggcatcatagtttttccagaatgacacagtagccaccggtggatgacagcccacgggcggcacagtcacttctgcctgttgctctgacaccaacccaggcagctctgctgtggcttctcctgggctctggcattagttggtctgtgtcacattgtcagaacaggtggctgctgtgtggtgccatcgagtccctgctggttccccttgtcctgggagggtcacccattgcccaaggaagtgcatccacctggcaggtgacctggaggagtagcttccccgaggacccccaggcttggcctgtgattgcgcaaacccacatttcctaagcacactggacacccttcgagtgtgggttttaacatccctgtgagattgaatacttgtgccacacatgtcacaaaagagtatggaaataaaagaaaatttatccgaagtgga

SEQ ID NO: 166974 - DNA, 915 bp, Homo sapiens
  Payload ID: 12870
  Gene Symbol: PARP12
  Gene Name: poly (ADP-ribose) polymerase family, member 12
  ENST ID: ENST00000489809
  CDS Start-End: 1-522
aaattggagaagttgggtatgagctcagacctggtgagcaggctgcctaccatttatagaaatgcacatgacatcaagaataagagctctgcccccagcagagtgcctcctctttttgtcccacaggggacttctgaaagaaaagacagttcaggttctgtgtccccaaacactcttagccaggaggagggtgatcagatctgtttgtaccatatccggaaaagttgtagctttcaagccttcgttcagaaaaacctggtctatggcacaactaaaaaggtttgccgcagacccaaatacgtgtctccccaggatgtgacgaccatgcaaacctgcaataccaagtttccaggcccgaagagcatcccagactattgggactcctctgccctgccagacccaggctttcaggcaaaaaggacagatgcagaagcagaacggagggaaggccgtggacgagcggcagctgttccacggcaccagcgccatttttgtggacgccatctgccagcagaactttgactggcgggtctgtggtgttcatggcacttcctacggcaaggggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatctttgagaaacaccaggtctacccagagtatgtcatccagtacaccacctcctccaagccctcggtcacaccctccatcctgctggccttgggctccctgttcagcagccgacagtgagcgcacaggagtgttccaggcctttc

SEQ ID NO: 166975 - DNA, 2861 bp, Homo sapiens
  Payload ID: 12870
  Gene Symbol: PARP12
  Gene Name: poly (ADP-ribose) polymerase family, member 12
  ENST ID: ENST00000473341
  CDS Start-End: 87-1349
caccctgcgagagccgcccgccagccagcgtccgccgccgtccgcgtcgcgccacccgcggtccgacgggagcaggcccagcggccatggcccaggccggcgtcgtcggtgaggtcacccaggtgctgtgcgcggccgggggcgccctggagttgcccgagctgcggcgccgcttgcggatgggcttgagcgccgacgcgctggagcggctgctgcggcagcgtgggcgcttcgtggtggcggtgcgggcgggcggcgcagccgcggccccggagcgcgtggtgctggccgcctcgccgctgcgcctgtgtcgcgcgcaccagggctccaagccgggctgcgtggggctctgcgcgcagctccacctctgcaggttcatggtctacggcgcctgcaagttcctgagagccgggaagaactgtaggaatagtcacagcttgacaaccgaacacaacctgagtgtgctgagaactcatggcgttgaccacctgagctataatgagctatgccaactcttgtttcagaacgacccctggcttttgccagaaatttgccaacattacaacaaaggagatggaccccacggctcttgtgcctttcaaaagcagtgcatcaagctccatatctgccagtattttttacagggggaatgcaagtttggcactagctgtaagagatcccatgatttctctaattctgagaatctggaaaaattggagaagttgggtatgagctcagacctggtgagcaggctgcctaccatttatagaaatgcacatgacatcaagaataagagctctgcccccagcagagtgcctcctctttttgtcccacaggggacttctgaaagaaaagacagttcaggttctgtgtccccaaacactcttagccaggaggagggtgatcagatctgtttgtaccatatccggaaaagttgtagctttcaagataagtgccatagagttcatttccatttgccgtatcgatggcaattcttggatagaggcaaatgggaggatttggacaacatggaacttattgaagaggcatattgcaatcccaaaatagaaaggatcctgtgctctgagtcagccagtacctttcactctcattgtctgaactttaacgccatgacttacggtgctacccaggctcgccgcctctccacggcctcctctgtcaccaaacctccacacttcatcctcaccactgactggatttggtactggagtgatgagtttggttcttggcaggaatatggaagacagccttcgttcagaaaaacctggtctatggcacaactaaaaaggtttgccgcagacccaaatacgtgtctccccaggatgtgacgaccatgcaaacctgcaataccaagtttccaggcccgaagagcatcccagactattgggactcctctgccctgccagacccaggctttcagaagatcacccttagttcttcctcggaagagtatcagaaggtctggaacctctttaaccgcacgctgcctttctactttgttcagaagattgagcgagtacagaacctggccctctgggaagtctaccagtggcaaaaaggacagatgcagaagcagaacggagggaaggccgtggacgagcggcagctgttccacggcaccagcgccatttttgtggacgccatctgccagcagaactttgactggcgggtctgtggtgttcatggcacttcctacggcaaggggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatctttgagaaacaccaggtctacccagagtatgtcatccagtacaccacctcctccaagccctcggtcacaccctccatcctgctggccttgggctccctgttcagcagccgacagtgagcgcacaggagtgttccaggcctttcacctgctctgccttgaaatggctatttgggcctttccttttctttttaaacagaaacttttaatgaactgttctcttaacattgacctctcaatgaagttatgttcttaatctcttgctaataatgatttttacttttaagtcacttttgggttcactagtggattaaccagaagtgattgtagttgagtccagttttgctttttaataatgtgttgaagttttagtttttactctttgttgactttgctgcttattggcaccagggacagagtttctagatacaattttatggattggttttaatttttatgagtttgtctctgcagtgattcggtttctcagagtctcatggcatcatagtttttccagaatgacacagtagccaccggtggatgacagcccacgggcggcacagtcacttctgcctgttgctctgacaccaacccaggcagctctgctgtggcttctcctgggctctggcattagttggtctgtgtcacattgtcagaacaggtggctgctgtgtggtgccatcgagtccctgctggttccccttgtcctgggagggtcacccattgcccaaggaagtgcatccacctggcaggtgacctggaggagtagcttccccgaggacccccaggcttggcctgtgattgcgcaaacccacatttcctaagcacactggacacccttcgagtgtgggttttaacatccctgtgagattgaatacttgtgccacacatgtcacaaaagagtatggaaataaaagaaaatttatccgaa

SEQ ID NO: 166976 - DNA, 874 bp, Homo sapiens
  Payload ID: 12870
  Gene Symbol: PARP12
  Gene Name: poly (ADP-ribose) polymerase family, member 12
  ENST ID: ENST00000491598
  CDS Start-End: 1-137
aaagaaaagacagttcaggttctgtgtccccaaacactcttagccaggaggagggtgatcagatctgtttgtaccatatccggaaaagttgtagctttcaagggcacggtgcaccctgtgaccactgtcagcagtagcgacgtggagaaggcctacctggcctactgtacaccggggtctgacggccaggcagccaccttgaagttccaggccggaaagcacaactacgagttagatttcaaagccttcgttcagaaaaacctggtctatggcacaactaaaaaggtttgccgcagacccaaatacgtgtctccccaggatgtgacgaccatgcaaacctgcaataccaagtttccaggcccgaagagcatcccagactattgggactcctctgccctgccagacccaggctttcaggcaaaaaggacagatgcagaagcagaacggagggaaggccgtggacgagcggcagctgttccacggcaccagcgccatttttgtggacgccatctgccagcagaactttgactggcgggtctgtggtgttcatggcacttcctacggcaaggggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatctttgagaaacaccaggtctacccagagtatgtcatccagtacaccacctcctccaagccctcggtcacaccctccatcctgctggccttgggctcc

SEQ ID NO: 166977 - DNA, 535 bp, Homo sapiens
  Payload ID: 12870
  Gene Symbol: PARP12
  Gene Name: poly (ADP-ribose) polymerase family, member 12
  ENST ID: ENST00000484111
  CDS Start-End: 1-230
ttgagcgagtacagaacctggccctctgggaagtctaccagtggcaaaaaggacagatgcagaagcagaacggagggaaggccgtggacgagcggcagctgttccacggcaccagcgccatttttgtggacgccatctgccagcagaactttgactggcgggtctgtggtgttcatggcacttcctacggcaagggtaggtggcatatattgtctcctttcaccctttaacacatcccaagaacaggacattatcttctgtaaccacaatatgcttaccaagttgagaacattttctgcccagcagtccatgttccgggtccatcagttctttgttagtcagtttccgtctgaggcagcgatggcaaggggtcaagatggacagcagccagtggtagacttgtggatttaaatgtacaggtgacagcttctaactcagatttccatttgacaaggctcataattctatacattgggctgccagagtctacagactgcttccgtatatgggatctcattcattttccatgccaacc

SEQ ID NO: 166978 - DNA, 7915 bp, Homo sapiens
  Payload ID: 12871
  Gene Symbol: PARP14
  Gene Name: poly (ADP-ribose) polymerase family, member 14
  Uniprot ID: Q460N5
  ENST ID: ENST00000474629
  CDS Start-End: 267-5672
ccgtggagcacaggtgaactgaggccgccttcccggggcgccgctggccagccccaaagggttactttggccttggctgtgggccgaatgcgaaggtggggaggtgggcgggggatgactctgccattcctgggtccgctgtgttaggctgaaggcaaaaggaaaccaaggcctgggagttttccaggaaacgaaagcgaaagagtcaaagttagcggcccggagttggcgcggcccctgcagtccggcggagagcggagctgaggatggctgtgcccggctccttcccgctgctggtcgagggctcctggggccccgaccccccgaagaacttgaacaccaagttgcagatgtacttccagagcccgaagaggtcgggaggcggcgagtgtgaggtccgccaggatcccaggagcccatcccgcttcctggtgttcttctacccggaggacgttcggcagaaggttctggagagaaaaaatcatgagttggtatggcaaggaaaaggaacattcaagttaactgtccagttacctgcaaccccagatgaaatcgatcatgtctttgaagaggaacttctaacaaaagaatccaagaccaaagaagatgttaaagaaccagatgtgtcagaagaattggatacaaaactccctcttgatggtggattagacaaaatggaagatatcccagaggaatgtgaaaatatttcctctttggtggcatttgaaaacctcaaggcaaatgtgactgacataatgctaatcttgttagtggagaacataagtggcctgtctaatgatgactttcaagtggaaataataagagattttgatgttgctgttgttacctttcaaaagcacatagatactataagatttgttgatgattgtaccaagcaccattcaattaaacaacttcagctttctccaagacttctggaagtgacaaacacaatcagggttgaaaacctgccacctggtgctgatgactacagtttaaaacttttctttgaaaatccctataatggagggggaagagttgccaatgttgaatattttcctgaagagagttcagctctgattgaattttttgacagaaaagtgttagacaccatcatggccacaaaactcgacttcaataaaatgccactttctgtgttcccatactatgcctcattgggcacagccttgtatggaaaggagaagcctctgatcaagcttccagcaccatttgaagagtcactagatcttcccttatggaagttcttacagaaaaagaatcacctcattgaggagataaacgatgaaatgaggcgttgtcactgtgagctcacgtggtcccaactcagtggtaaagttaccatcagaccagcagccaccttagtcaatgaaggaagaccgagaatcaagacctggcaggcagatacttccacaacactctctagcatcaggtctaaatataaagtcaacccaattaaagtggatccaacaatgtgggacaccataaaaaatgatgtgaaagatgacaggattttgattgagtttgatacacttaaggagatggtaatcttagcagggaaatcagaggatgtccaaagcattgaggtacaagtcagggagttaatagaaagcactactcaaaaaattaaaagggaagagcaaagtttgaaggaaaaaatgatcatttctccaggcaggtattttcttttgtgtcacagcagtctactggaccatttactcacggagtgcccagagatagagatttgttacgatagagtcactcaacacttgtgcttgaaaggacctagtgcagatgtgtataaagcaaagtgtgaaatccaggaaaaggtgtacaccatggctcagaaaaacattcaggtttctcctgagatttttcagtttttgcaacaggtaaactggaaagaattctctaagtgtcttttcatagcacagaagattcttgcactttatgagctagagggtacaactgttctcttaaccagctgttcttctgaagccctgttagaagcagaaaagcaaatgctcagtgccttaaattataagcgcattgaagttgagaacaaagaagttcttcatggcaagaaatggaaagggctcactcacaatttgcttaagaaacaaaattcctccccaaacactgtaatcatcaatgagttaacttcagaaaccacagctgaagtcatcattacaggctgtgtaaaagaagtaaatgaaacctataaattgctttttaacttcgttgaacaaaacatgaaaatagagagactggttgaagtaaagccttccttagttattgactatttaaagacagaaaagaagctattctggccaaagataaagaaggtaaatgtgcaggtaagtttcaatcctgagaacaaacaaaaaggcattttactaactggctcaaagaccgaagtactgaaggcagtggacattgtcaagcaagtctgggattcagtctgtgttaaaagtgtccatactgataagccaggagccaagcagttcttccaggataaagcacggttttatcaaagtgagatcaaacggttgtttggttgttacattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatatgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgaagtcagtctttcttcagcttccctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtca

SEQ ID NO: 166979 - DNA, 581 bp, Homo sapiens
  Payload ID: 12871
  Gene Symbol: PARP14
  Gene Name: poly (ADP-ribose) polymerase family, member 14
  ENST ID: ENST00000494811
  CDS Start-End: 1-581
agtccggcggagagcggagctgaggatggctgtgcccggctccttcccgctgctggtcgagggctcctggggccccgaccccccgaagaacttgaacaccaagttgcagatgtacttccagagcccgaagaggtcgggaggcggcgagtgtgaggtccgccaggatcccaggagcccatcccgcttcctggtgttcttctacccggaggacgttcggcagaaggttctggagagaaaaaatcatgagttggtatggcaaggaaaaggaacattcaagttaactgtccagttacctgcaaccccagatgaaatcgatcatgtctttgaagaggaacttctaacaaaagaatccaagaccaaagaagatgttaaagaaccagatactataagatttgttgatgattgtaccaagcaccattcaattaaacaacttcagctttctccaagacttctggaagtgacaaacacaatcagggttgaaaacctgccacctggtgctgatgactacagtttaaaacttttctttgaaaatccctataatggagggggaagagttgccaatgttgaatattttcctgaag

SEQ ID NO: 166980 - DNA, 8437 bp, Homo sapiens
  Payload ID: 12871
  Gene Symbol: PARP14
  Gene Name: poly (ADP-ribose) polymerase family, member 14
  ENST ID: ENST00000460683
  CDS Start-End: 1-4566
gtgactgacataatgctaatcttgttagtggagaacataagtggcctgtctaatgatgactttcaagtggaaataataagagattttgatgttgctgttgttacctttcaaaagcacatagatactataagatttgttgatgattgtaccaagcaccattcaattaaacaacttcagctttctccaagacttctggaagtgacaaacacaatcagggttgaaaacctgccacctggtgctgatgactacagtttaaaacttttctttgaaaatccctataatggagggggaagagttgccaatgttgaatattttcctgaagagagttcagctctgattgaattttttgacagaaaagtgttagacaccatcatggccacaaaactcgacttcaataaaatgccactttctgtgttcccatactatgcctcattgggcacagccttgtatggaaaggagaagcctctgatcaagcttccagcaccatttgaagagtcactagatcttcccttatggaagttcttacagaaaaagaatcacctcattgaggagataaacgatgaaatgaggcgttgtcactgtgagctcacgtggtcccaactcagtggtaaagttaccatcagaccagcagccaccttagtcaatgaaggaagaccgagaatcaagacctggcaggcagatacttccacaacactctctagcatcaggtctaaatataaagtcaacccaattaaagtggatccaacaatgtgggacaccataaaaaatgatgtgaaagatgacaggattttgattgagtttgatacacttaaggagatggtaatcttagcagggaaatcagaggatgtccaaagcattgaggtacaagtcagggagttaatagaaagcactactcaaaaaattaaaagggaagagcaaagtttgaaggaaaaaatgatcatttctccaggcaggtattttcttttgtgtcacagcagtctactggaccatttactcacggagtgcccagagatagagatttgttacgatagagtcactcaacacttgtgcttgaaaggacctagtgcagatgtgtataaagcaaagtgtgaaatccaggaaaaggtgtacaccatggctcagaaaaacattcaggtttctcctgagatttttcagtttttgcaacaggtaaactggaaagaattctctaagtgtcttttcatagcacagaagattcttgcactttatgagctagagggtacaactgttctcttaaccagctgttcttctgaagccctgttagaagcagaaaagcaaatgctcagtgccttaaattataagcgcattgaagttgagaacaaagaagttcttcatggcaagaaatggaaagggctcactcacaatttgcttaagaaacaaaattcctccccaaacactgtaatcatcaatgagttaacttcagaaaccacagctgaagtcatcattacaggctgtgtaaaagaagtaaatgaaacctataaattgctttttaacttcgttgaacaaaacatgaaaatagagagactggttgaagtaaagccttccttagttattgactatttaaagacagaaaagaagctattctggccaaagataaagaaggtaaatgtgcaggtaagtttcaatcctgagaacaaacaaaaaggcattttactaactggctcaaagaccgaagtactgaaggcagtggacattgtcaagcaagtctgggattcagtctgtgttaaaagtgtccatactgataagccaggagccaagcagttcttccaggataaagcacggttttatcaaagtgagatcaaacggttgtttggttgttacattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatatgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaaggtaagccttctgctagaatgcagtttctggatggtggaaataagttctgtcatggtcctatataaaatccattttcattcacttcctatcacatttttttaaacccagaattagaatttgtatggtaattagtagttctagattctactcatgtgaccataattactgaggcattaagattcttgtgtcagtgattacaatatttgattgtaatatgatagaacactaaagacatatatttactttgtgaagcaagctaatacaaattcaaagatatggctttaaaattggatttgatagctagcaaattccacagagagccatgcagaggctccttagatcaggaccatgttactctgccccattattcacagatcaacagtgcttccttgataaagccagcaggccttttctcgtttatcataattattttgggcaggtgaatgtgatgattcgtgcctgtagtcccagctattgggaggctgaggtggaaggattgcatgagcccaggagtttgacgccagtctgggtaacatagtgagatcctgctctcaaataaaaacaaccaattattttggcatcttcttccatttttaaacatttttgatattgctgtttgaaattatattttccttgacttctctagcaaaattattatgatttttttttccttgactaattttcttttcatttttgcaggcacgctgtttctcttccaaacccctaattctagctttattcacgccatttatgcttaaacggtcttttgtctctgtacctcaccagggaatatatttacccttcttggattcaactattagttcaatgtcaatagctcccaaatcaacattaccaacctgggtctttgactcaagctctagaacatactcccagtggcctaaaaaaatctccacttgaggctgggcacagtggctcacgcctgtaatcccagcactttgggaggccgaggtgggtggatcacgaggtcaggggttcaagaccatcctggtgaagatggtgaaaccacgtctctactaaaactacaaaaattagccgggcatgttggcaggtgcctataatcccacctacttgggaggctgaggcaggataattgcttgaacatgggtggcagagattgcagtgagccaagatcacgccactgcactccagcctggtcgacagagtgagactccgtctcaaaaaaaaaatctccacttgaatatctaactgcaaaatcaacttctctaaaatctaatgcatcatacattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgaagtcagtctttcttcagcttccctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtca

SEQ ID NO: 166981 - DNA, 1518 bp, Homo sapiens
  Payload ID: 12872
  Gene Symbol: PARP15
  Gene Name: poly (ADP-ribose) polymerase family, member 15
  Uniprot ID: Q460N3
  ENST ID: ENST00000310366
  CDS Start-End: 96-1430
ttcctaggttgaaccgcaatcctttaagaagtctctgagggaagaggaaatattttgagaactattgttatcaactctttgatatctgatgatcaatgctccaaagaattggattaatatttttacacaatattgttgtagtcagtaactgtttctatttccaggcatttttagatgaattcactaactggtcaagaataaatcccaacaaggccaggattcccatggcaggagatacccaaggtgtggtcgggactgtctctaagccttgtttcacagcatatgaaatgaaaatcggtgcaattacttttcaggttgctactggagatatagccactgaacaggtagatgttattgtaaactcaacagcaaggacatttaatcggaaatcaggtgtgtcaagagctattttagaaggtgctggacaagctgtggaaagtgaatgtgctgtactagctgcacagcctcacagagattttataattacaccaggtggatgcttaaagtgcaaaataataattcatgttcctgggggaaaagatgtcaggaaaacggtcaccagtgttctagaagagtgtgaacagaggaagtacacatcggtttcccttccagccattggaacaggaaatgccggaaaaaaccctatcacagttgctgataacataatcgatgctattgtagacttctcatcacaacattccaccccatcattaaaaacagttaaagttgtcatttttcaacctgagctgctaaatatattctacgacagcatgaaaaaaagagacctctctgcatcactgaactttcagtccacattctccatgactacatgtaatcttcctgaacactggactgacatgaatcatcagctgttttgcatggtccagctagagccaggacaatcagaatataataccataaaggacaagttcacccgaacttgttcttcctacgcaatagagaagattgagaggatacagaatgcatttctctggcagagctaccaggtaaagaaaaggcaaatggatatcaagaatgaccataagaataatgagagactcctcttccatgggacagatgcagactcagtgccatatgtcaatcagcacggctttaatagaagttgtgctgggaaaaatgctgtatcctatggaaaaggaacctattttgctgtggatgccagttattctgccaaggacacctactccaagccagacagcaatgggagaaagcacatgtacgttgtgcgagtacttactggagtcttcacaaagggacgtgcaggattagtcacccctccacccaagaatcctcacaatcccacagatctctttgactcagtgacaaacaatacacgatctccaaagctatttgtggtattctttgataatcaggcttacccagaatatctcataactttcacggcttaaaaatatttttatcatcaaagagatgatttaagtcatctgtaagaacaacatgcaatctttgtctttgcttctggcctgtgtaagcaga

SEQ ID NO: 166982 - DNA, 2156 bp, Homo sapiens
  Payload ID: 12872
  Gene Symbol: PARP15
  Gene Name: poly (ADP-ribose) polymerase family, member 15
  Uniprot ID: Q460N3
  ENST ID: ENST00000464300
  CDS Start-End: 67-2103
agagaaaagaagttcgaggcacaagcctgttgggtggggcgcaactgcagtcccagcgagctgaggatggctgcgccaggcccccttcctgccgctgctctgagtccaggggctccgacccccagagaacttatgcacggagttgcaggtgttacttccagagccggacgagatcgggaggcggggagcgtgctgccggccgggaaccgtggggcgcggaaggcctcccggcgctcttcctcccggagtatgtccagagacaacaagttcagcaagaaagattgtctttcaatcaggaatgttgtagcttcaatccaaaccaaagaaggtctgaatctcaagttgataagtggagatgttctgtacatctgggccgatgtcattgtcaacagcgttcccatgaatcttcagcttggaggaggaccactatctcgggcatttttgcagaaagctggtcccatgctccagaaagagttagatgacagaaggcgggaaacagaggaaaaagtaggtaacatattcatgacaagcggctgcaatctggactgcaaagctgtgctccatgctgtggctccatactggaataatggagcagagacttcttggcagatcatggcaaatataatcaagaaatgtttgacaactgtagaagtgctatctttctcatcaatcacatttcccatgattggaacaggaagtttgcagtttcccaaagctgtttttgctaaactaatcctttcagaagtgttcgaatacagtagcagcacaaggccgataactagccctttacaagaagtccactttctggtatatacaaatgacgatgaaggctgtcaggcatttttagatgaattcactaactggtcaagaataaatcccaacaaggccaggattcccatggcaggagatacccaaggtgtggtcgggactgtctctaagccttgtttcacagcatatgaaatgaaaatcggtgcaattacttttcaggttgctactggagatatagccactgaacaggtagatgttattgtaaactcaacagcaaggacatttaatcggaaatcaggtgtgtcaagagctattttagaaggtgctggacaagctgtggaaagtgaatgtgctgtactagctgcacagcctcacagagattttataattacaccaggtggatgcttaaagtgcaaaataataattcatgttcctgggggaaaagatgtcaggaaaacggtcaccagtgttctagaagagtgtgaacagaggaagtacacatcggtttcccttccagccattggaacaggaaatgccggaaaaaaccctatcacagttgctgataacataatcgatgctattgtagacttctcatcacaacattccaccccatcattaaaaacagttaaagttgtcatttttcaacctgagctgctaaatatattctacgacagcatgaaaaaaagagacctctctgcatcactgaactttcagtccacattctccatgactacatgtaatcttcctgaacactggactgacatgaatcatcagctgttttgcatggtccagctagagccaggacaatcagaatataataccataaaggacaagttcacccgaacttgttcttcctacgcaatagagaagattgagaggatacagaatgcatttctctggcagagctaccaggtaaagaaaaggcaaatggatatcaagaatgaccataagaataatgagagactcctcttccatgggacagatgcagactcagtgccatatgtcaatcagcacggctttaatagaagttgtgctgggaaaaatgctgtatcctatggaaaaggaacctattttgctgtggatgccagttattctgccaaggacacctactccaagccagacagcaatgggagaaagcacatgtacgttgtgcgagtacttactggagtcttcacaaagggacgtgcaggattagtcacccctccacccaagaatcctcacaatcccacagatctctttgactcagtgacaaacaatacacgatctccaaagctatttgtggtattctttgataatcaggcttacccagaatatctcataactttcacggcttaaaaatatttttatcatcaaagagatgatttaagtcatctgtaagaacaacatgc

SEQ ID NO: 166983 - DNA, 4439 bp, Homo sapiens
  Payload ID: 12872
  Gene Symbol: PARP15
  Gene Name: poly (ADP-ribose) polymerase family, member 15
  ENST ID: ENST00000483793
  CDS Start-End: 41-1492
ctgttgggtggggcgcaactgcagtcccagcgagctgaggatggctgcgccaggcccccttcctgccgctgctctgagtccaggggctccgacccccagagaacttatgcacggagttgcaggtgttacttccagagccggacgagatcgggaggcggggagcgtgctgccggccgggaaccgtggggcgcggaaggcctcccggcgctcttcctcccggagtatgtccagagacaacaagttcagcaagaaagattgtctttcaatcaggaatgttgtagcttcaatccaaaccaaagaaggtctgaatctcaagttgataagtggagatgttctgtacatctgggccgatgtcattgtcaacagcgttcccatgaatcttcagcttggaggaggaccactatctcgggcatttttgcagaaagctggtcccatgctccagaaagagttagatgacagaaggcgggaaacagaggaaaaagtaggtaacatattcatgacaagcggctgcaatctggactgcaaagctgtgctccatgctgtggctccatactggaataatggagcagagacttcttggcaggttgctactggagatatagccactgaacaggtagatgttattgtaaactcaacagcaaggacatttaatcggaaatcaggtgtgtcaagagctattttagaaggtgctggacaagctgtggaaagtgaatgtgctgtactagctgcacagcctcacagagattttataattacaccaggtggatgcttaaagtgcaaaataataattcatgttcctgggggaaaagatgtcaggaaaacggtcaccagtgttctagaagagtgtgaacagaggaagtacacatcggtttcccttccagccattggaacaggtaatcttcctgaacactggactgacatgaatcatcagctgttttgcatggtccagctagagccaggacaatcagaatataataccataaaggacaagttcacccgaacttgttcttcctacgcaatagagaagattgagaggatacagaatgcatttctctggcagagctaccaggtaaagaaaaggcaaatggatatcaagaatgaccataagaataatgagagactcctcttccatgggacagatgcagactcagtgccatatgtcaatcagcacggctttaatagaagttgtgctgggaaaaatgctgtatcctatggaaaaggaacctattttgctgtggatgccagttattctgccaaggacacctactccaagccagacagcaatgggagaaagcacatgtacgttgtgcgagtacttactggagtcttcacaaagggacgtgcaggattagtcacccctccacccaagaatcctcacaatcccacagatctctttgactcagtgacaaacaatacacgatctccaaagctatttgtggtattctttgataatcaggcttacccagaatatctcataactttcacggcttaaaaatatttttatcatcaaagagatgatttaagtcatctgtaagaacaacatgcaatctttgtctttgcttctggcctgtgtaagcagatgaaagtttcccttttaggtgccaaaatgctgaaaattacctttttaaagtgctctattgctgcgatttgtagcatacctttttttctcagcaaattgatgggtggaagctgagaaatgtatggtaaatgtcacagagctacaaccattcacagacaccaaatctctaggagaataaaaagcacattattctttttctatcagaaaaaaacaagatgcatcaccttaaaaccaagatgacattgttcttcttggaacatgttaagacatcgaatggtggcgggttaaactgtactgcttaagtggagcggctaccgttatgcatctatcacagttggggattttgccttattaaggaaaacttgtcaatagttcagctgaaatgactgaatcacagaatattaactctgttatggaacaaatcataacagattttacctgtttacatttcaggtaaaaatgtatcgcattgttatctaatattaaaaaattacccccaattttagtgacttaatcccacacagtctttatgggtcaggaattcaggcatggcttacctggatcattctgctagggtctctctgaagttacagacaagatgtcaggggatgtggtcgtttgaaggcttgtctgggctggaggtctatttccaaggtgaatcactcacatacctggcacgtttctgtcaggtattggcagtcctcagttcctctcctctcaggcctctccacaggctgcttgagtgtcctcatgacacaacagttggcttactccagagtgagcaactcaagagagagcaaggcagaagctaccaaatctttatgtttgaagtcatgcaccatcttttccacgagtatcctgttgattattttgatcagcttgttcagtctgggagggaattgcacaagggcatgaatactccactggcaaggatcattgggggccatcttggaagctgtgtgaatgagcaaatgaatgcacagatagaatattagcagtgacaatgatgctagaggtcacctaccccactgtcctcttgtccttctcccccaaccctcccctgctcccaggcaagaagccctctagcctctgcttgatcactttcagcactcaacatcttcagggaacctattccgccgtgggacagtgttaattagtggaaaactctttttcaaaagttgaaatcagttcctctgtgtctattacctgctgatcactgtccagacttctggaggacacagagcaagttttattcctcttactgatggtagcctttcagatccatcccttccctccagtatattagagttacgtaaattcttaaaatgcttagcagctcatttatcctgaagcatcacttttgaagagttacagacatttaagaagtatttacattatcataaataaattacatgcgcatttaaagagaacagaaaagtataaagaaaaataactcaccaaactcactcataattccagcactaagggaaaaccactgccaatttctcatgtctcccttccagtttcttctctgtccaaattcaacaaagtcaaaatcacattttgttctgtcacaaatcatataatattatttctaccatttttctttttttaatctttttttattatactttaagttttagggtacatgtgcacaatgtgcagtttagttacatatgtaaacatgtgccatgttggtgtgctgcacccagtaactcatcatttagcattaggtatatctccaaatgctatccctctcccctctccccaccccacaacaggccccggtgtgtgatgttccccttcctgtgtccatgtgttctcattgttcaattcccacctgtgagtgagaacatgtggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttacagcagcatgatttataatcctttgggtatatacccagtaatgggattgctgggtcaaatggtatttctagttctagatccccgaggaatcgccacactgacttccacaatggttgaactagtttacagtcccaccaacagtgtaaaagtgttcctatttctccacatcctctccagcacctgttgcttcctaactttttaatgattgccattctaacgggtgtgggatggtatctcattgttgttttgatttgcatttctctgatggccagtgatgatgagcattttttcatgtgttttttggctgcataaatgtcttcttttgagaagtgtccgttcatatcctttgcccactttttgatggggttctttgtttttttcttgtatatttgtttgagttcattgtagattctggatattagccctttgtcagatgagtagattgcaaaaattttctcccattctgtaggttgcctgttcactctgatggtagtttcttttgttgtacagaagctctttagtttaattagatcccatatttctaccatttttcattaaacattacaagttgttctcttgtgttcttattttttctgtaaacataattttaatggcagagatattctgctttatatctttccctattttatgtatatagaattataaagtttttaaaaatgtaatcatcattatttatagtttaataatcagtttcatcttgcagtgtatcattttcctcgtcattaaatattttacgtatcatttttaa

SEQ ID NO: 166984 - DNA, 1311 bp, Homo sapiens
  Payload ID: 12872
  Gene Symbol: PARP15
  Gene Name: poly (ADP-ribose) polymerase family, member 15
  ENST ID: ENST00000493645
  CDS Start-End: 96-1223
ttcctaggttgaaccgcaatcctttaagaagtctctgagggaagaggaaatattttgagaactattgttatcaactctttgatatctgatgatcaatgctccaaagaattggattaatatttttacacaatattgttgtagtcagtaactgtttctatttccaggcatttttagatgaattcactaactggtcaagaataaatcccaacaaggccaggattcccatggcaggagatacccaaggtgtggtcgggactgtctctaagccttgtttcacagcatatgaaatgaaaatcggtgcaattacttttcaggttgctactggagatatagccactgaacaggtagatgttattgtaaactcaacagcaaggacatttaatcggaaatcaggtgtgtcaagagctattttagaaggtgctggacaagctgtggaaagtgaatgtgctgtactagctgcacagcctcacagagattttataattacaccaggtggatgcttaaagtgcaaaataataattcatgttcctgggggaaaagatgtcaggaaaacggtcaccagtgttctagaagagtgtgaacagaggaagtacacatcggtttcccttccagccattggaacaggtaatcttcctgaacactggactgacatgaatcatcagctgttttgcatggtccagctagagccaggacaatcagaatataataccataaaggacaagttcacccgaacttgttcttcctacgcaatagagaagattgagaggatacagaatgcatttctctggcagagctaccaggtaaagaaaaggcaaatggatatcaagaatgaccataagaataatgagagactcctcttccatgggacagatgcagactcagtgccatatgtcaatcagcacggctttaatagaagttgtgctgggaaaaatgctgtatcctatggaaaaggaacctattttgctgtggatgccagttattctgccaaggacacctactccaagccagacagcaatgggagaaagcacatgtacgttgtgcgagtacttactggagtcttcacaaagggacgtgcaggattagtcacccctccacccaagaatcctcacaatcccacagatctctttgactcagtgacaaacaatacacgatctccaaagctatttgtggtattctttgataatcaggcttacccagaatatctcataactttcacggcttaaaaatatttttatcatcaaagagatgatttaagtcatctgtaagaacaacatgcaatctttgtctttgcttctggcctgtgtaagcaga

SEQ ID NO: 166985 - DNA, 2731 bp, Homo sapiens
  Payload ID: 12873
  Gene Symbol: PARP16
  Gene Name: poly (ADP-ribose) polymerase family, member 16
  Uniprot ID: Q8N5Y8
  ENST ID: ENST00000261888
  CDS Start-End: 447-1418
gcggcgcagcagcctcgcccgtcgcggagagtgggctctgcccgccgtcccccgggggctgcttcccgccccaggcctccgcggaggacacgtgtcagcacgttcccgcggttgtcattccattgtcatagcccttcccctaggccgggaacccctcccccccaccagccccagttcctttatccctgggcccaacctccccgccgacccgcggtccaggcctcggtctctctcttcggcggcgagccgcggcccagaccccggcagaggacacttgtcggcacgttctcacccctgtcatctcagccccctgcctagctccaccccaggcttgggaacccggcccctgacggcccattgtccgcgggcccagcccccgcgctgaacgcacgctcgcccttgcccctaaccagcgcgtctaccccggcaacgcgcagtgacctgggatgcagccctcaggctgggcggccgccagggaggcggcgggccgcgacatgctggccgccgacctccggtgcagcctcttcgcctcggccctgcagagctacaagcgcgactcggtgctgcggcccttccccgcgtcctacgcccgcggcgactgtaaggactttgaagccctgcttgcagatgccagcaagttacctaacctgaaagaacttctccagtcctccggagacaaccacaaacgggcctgggacctggtgagctggattttatcctcaaaggtcctgacaatccacagtgcagggaaggcagagtttgaaaagatccaaaagctgactggggctcctcacacgcctgttcctgcaccggacttcctgtttgaaattgagtactttgacccagccaacgccaaattttatgagaccaaaggagaacgagacctaatctatgcatttcatggtagccgcctagaaaacttccattccattatccacaatggcctgcactgccatctgaacaagacatccttgttcggagaggggacctacctcaccagtgacttgagcctggccctcatatacagcccccatggccatgggtggcagcacagcctcctcggccccatccttagctgtgtggccgtgtgtgaggtcattgaccatccggacgtcaagtgccaaaccaagaagaaggattccaaggagatagatcgcagacgagcgagaatcaaacatagtgaagggggagacatccctcccaagtacttcgtggtcaccaataaccagctgctgcgagtgaagtacctcctggtgtattcacagaagccacccaagagcagggcttcgagccagctctcctggttttccagccattggtttaccgtcatgatatccctgtatctgctgctgctgctcatagtgagtgtcatcaactcctctgctttccaacacttttggaatcgtgcgaaaagataatctttctgggcctggtgtgggggctacctcaactatgtgccttatggtaacttgttctgtacctcctatgcctcatgtccagccaggttgagcctaggggccagttgggggaccacaggacaattttcatatggcctaaatgtatccattgcctttgatgatgttcccagccatactccagtcaacggggactactagtccctcactcttaggttttaggggagtccttccatctgctccttcttaaactgtcctagggagttggcttttcagccagggccaaaggaaaaagccctgctgcatttaaaaacaaagtgtccaagctgtcagtggtgtgtttacaatctctcctggcagaggttggccctttctctaatgccttctggaaggcggaaaatgtgggaactataaatcactaggcggttgccttgttttgacttgagacacccaagaggaacagtcatgtttctcataaaaatcagtgggatcatttttgaattccatcagcctttgtatgtgagtgcaaaacattttaacagttttctcaaatcaacaaacagccttctcctatagctgtacttgcccccctccccaaaaaaccatggatgagaaagaaaggagtcaggggcctgataaaaaatacagacttaatgagcaactcaagatgagaaaactgctctttttccaaaaattaccaactgctgattacagctgaaatggaaccaaatgtttgttttctgatttttttttaatagctgtttaacaaattagtctttgctgagtaaaaggggaaatttctaaacctagtgcactgtttggccagtgtccacagcctcttttctggctgtgttttagagaaagggatttgagctataggctcgcctcctgttctcattctcacaaagctgccttgactgtggcctgcaaccacgagtgccatgctttcaggtcttctgtggcctactggccttcaagacagaggcctgccccagtgtgccacagatccatgtggatggagcctccttcagaggggtcacaggtctttgagactcagcctgggctttaatgtgtaggaaaagccttctggccacccagagagccggagccctgcttgctgtattctctgctcccttcttcctgctgggttttagccataatagggcccggtacgatttgggagtgacatttctgtaaagaagaggaaaaatcatttttctataatttgtaaagttgtgaaagagccactaccacagtttttacattgattattggaacatttcagaataaataaagatattttcttaatgatttaa

SEQ ID NO: 166986 - DNA, 2352 bp, Homo sapiens
  Payload ID: 12873
  Gene Symbol: PARP16
  Gene Name: poly (ADP-ribose) polymerase family, member 16
  Uniprot ID: Q8N5Y8
  ENST ID: ENST00000444347
  CDS Start-End: 418-1041
agtgggctctgcccgccgtcccccgggggctgcttcccgccccaggcctccgcggaggacacgtgtcagcacgttcccgcggttgtcattccattgtcatagcccttcccctaggccgggaacccctcccccccaccagccccagttcctttatccctgggcccaacctccccgccgacccgcggtccaggcctcggtctctctcttcggcggcgagccgcggcccagaccccggcagaggacacttgtcggcacgttctcacccctgtcatctcagccccctgcctagctccaccccaggcttgggaacccggcccctgacggcccattgtccgcgggcccagcccccgcgctgaacgcacgctcgcccttgcccctaaccagcgcgtctaccccggcaacgcgcagtgacctgggatgcagccctcaggctgggcggccgccagggaggcggcgggccgcgacatgctggccgccgacctccggtgcagcctcttcgcctcggccctgcagagctacaagcgcgactcggtgctgcggcccttccccgcgtcctacgcccgcggcgactgtaaggactttgaagccctgacatccttgttcggagaggggacctacctcaccagtgacttgagcctggccctcatatacagcccccatggccatgggtggcagcacagcctcctcggccccatccttagctgtgtggccgtgtgtgaggtcattgaccatccggacgtcaagtgccaaaccaagaagaaggattccaaggagatagatcgcagacgagcgagaatcaaacatagtgaagggggagacatccctcccaagtacttcgtggtcaccaataaccagctgctgcgagtgaagtacctcctggtgtattcacagaagccacccaagagggcttcgagccagctctcctggttttccagccattggtttaccgtcatgatatccctgtatctgctgctgctgctcatagtgagtgtcatcaactcctctgctttccaacacttttggaatcgtgcgaaaagataatctttctgggcctggtgtgggggctacctcaactatgtgccttatggtaacttgttctgtacctcctatgcctcatgtccagccaggttgagcctaggggccagttgggggaccacaggacaattttcatatggcctaaatgtatccattgcctttgatgatgttcccagccatactccagtcaacggggactactagtccctcactcttaggttttaggggagtccttccatctgctccttcttaaactgtcctagggagttggcttttcagccagggccaaaggaaaaagccctgctgcatttaaaaacaaagtgtccaagctgtcagtggtgtgtttacaatctctcctggcagaggttggccctttctctaatgccttctggaaggcggaaaatgtgggaactataaatcactaggcggttgccttgttttgacttgagacacccaagaggaacagtcatgtttctcataaaaatcagtgggatcatttttgaattccatcagcctttgtatgtgagtgcaaaacattttaacagttttctcaaatcaacaaacagccttctcctatagctgtacttgcccccctccccaaaaaaccatggatgagaaagaaaggagtcaggggcctgataaaaaatacagacttaatgagcaactcaagatgagaaaactgctctttttccaaaaattaccaactgctgattacagctgaaatggaaccaaatgtttgttttctgatttttttttaatagctgtttaacaaattagtctttgctgagtaaaaggggaaatttctaaacctagtgcactgtttggccagtgtccacagcctcttttctggctgtgttttagagaaagggatttgagctataggctcgcctcctgttctcattctcacaaagctgccttgactgtggcctgcaaccacgagtgccatgctttcaggtcttctgtggcctactggccttcaagacagaggcctgccccagtgtgccacagatccatgtggatggagcctccttcagaggggtcacaggtctttgagactcagcctgggctttaatgtgtaggaaaagccttctggccacccagagagccggagccctgcttgctgtattctctgctcccttcttcctgctgggttttagccataatagggcccggtacgatttgggagtgacatttctgtaaagaagaggaaaaatcatttttctataatttgtaaagttgtgaaagagccactaccacagtttttacattgattattggaacatttcagaataaataaagatattttcttaatgattt

SEQ ID NO: 166987 - DNA, 678 bp, Homo sapiens
  Payload ID: 12873
  Gene Symbol: PARP16
  Gene Name: poly (ADP-ribose) polymerase family, member 16
  ENST ID: ENST00000559805
  CDS Start-End: 1-217
cagacgagcgagaatcaaacatagtgaagggggagacatccctcccaagtacttcgtggtcaccaataaccagctgctgcgagtgaagtacctcctggtgtattcacagaagccacccaagagggcttcgagccagctctcctggttttccagccattggtttaccgtcatgatatccctgtatctgctgctgctgctcatagcactgggaatctgaagaggtgtctgtggccagagtaaagccagagtgtggccatctaaagggtgggcccaggacaagggcctcatggaaaggaactgtggaaagtagagaggacccacctgccatgctgtgaggacacccaggccacatagagagagtgaggccacatgtaggttttacagccagaagccccactgaaaaccaaacctgcaaccagcatcaactgccaaacatgtactgaagaggctgagatgattccagcacttgtggatgactgcaaccacatgagagacccagagcaagagctacctagctgagcccagttactcccagaatcatgagagaactatgtaattgattgttattactatataagccactaagtttacatatgatatgttatgcagcagtagacagctggaacaggagccaataaacaccgaatgaataaatgtggataggtctggttgaatgaa

SEQ ID NO: 166988 - DNA, 2336 bp, Homo sapiens
  Payload ID: 12874
  Gene Symbol: PARP3
  Gene Name: poly (ADP-ribose) polymerase family, member 3
  Uniprot ID: Q9Y6F1
  ENST ID: ENST00000398755
  CDS Start-End: 332-1954
ggtcaccgcgcgaccggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttggccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccgctggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatgttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctccttt

SEQ ID NO: 166989 - DNA, 2472 bp, Homo sapiens
  Payload ID: 12874
  Gene Symbol: PARP3
  Gene Name: poly (ADP-ribose) polymerase family, member 3
  ENST ID: ENST00000417220
  CDS Start-End: 489-2090
gtatccgggcccaaggtcaccgcgcgaccggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttggctcggtgactcggcccggcaaccatgccagggctgaactagctgacacagggggaggagccccgaagtggaagagagagagcctcctttcactttccctacccctcaggacacacaggacagccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccgctggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatgttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctccttt

SEQ ID NO: 166990 - DNA, 2360 bp, Homo sapiens
  Payload ID: 12874
  Gene Symbol: PARP3
  Gene Name: poly (ADP-ribose) polymerase family, member 3
  ENST ID: ENST00000431474
  CDS Start-End: 372-1973
gtatccgggcccaaggtcaccgcgcgaccggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttgggacagccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccgctggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatgttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctccttttttaa

SEQ ID NO: 166991 - DNA, 2070 bp, Homo sapiens
  Payload ID: 12874
  Gene Symbol: PARP3
  Gene Name: poly (ADP-ribose) polymerase family, member 3
  ENST ID: ENST00000471971
  CDS Start-End: 320-481
accggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttgggacagccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccgctggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatgttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactata

SEQ ID NO: 166992 - DNA, 1040 bp, Homo sapiens
  Payload ID: 12874
  Gene Symbol: PARP3
  Gene Name: poly (ADP-ribose) polymerase family, member 3
  ENST ID: ENST00000498510
  CDS Start-End: 46-1040
ggagaccatggaggcctaagggcctctctgtgccccaggacagccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccgctggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctgg

SEQ ID NO: 166993 - DNA, 5474 bp, Homo sapiens
  Payload ID: 12875
  Gene Symbol: PARP4
  Gene Name: poly (ADP-ribose) polymerase family, member 4
  Uniprot ID: Q9UKK3
  ENST ID: ENST00000381989
  CDS Start-End: 107-5281
cgcccgcccagccccgggggcagggagagcctagattacggaagtaccgcgagcaaggagcgcggaatcggggagcgtccggagctagctggatcctctaggcaggatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagggaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggacttttccttaactgaagcaccaccaggctacgacagtgtgcatggagtttcgcaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccagtgagagcgaagtgattatttgtcttgactgctccagttccatggagggtgtgacattcttgcaagccaagcaaatcgccttgcatgcgctgtccttggtgggtgagaagcagaaagtaaatattatccagttcggcacaggttacaaggagctattttcgtatcctaagcatatcacaagcaataccatggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgtgcccgaggccctgcaggccccagcccaggtgccgtccttgtttctcaatgatcgactccttgtctatggattcattcctcactgcacacaggcaactctgtgtgcactaattcaagagaaagaatttcgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcgccttttcctgatattccaaaagtttctgaacttattgccaaagaagatgtagacttcctgccctacatgagctggcagggggagccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttcccccgactgcccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttcttcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttcctctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaaatgtgatacaaaagatgacagtatcctgtgctttctggaagtaaaagaagaggatgaaatagtgtgcatacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacgcttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaagtcaaatgaaactgaattttaaactttttgcatgcttctatgtagaaaataatcaaatgataatagatacttataatgaaacttcattaaggtttcattcagtgtagcaattactgtctttaaaaattaagtggaagaagaattactttaatcaactaacaagcaataataaaatgaaacttaaaatatttca

SEQ ID NO: 166994 - DNA, 2142 bp, Homo sapiens
  Payload ID: 12876
  Gene Symbol: PARP6
  Gene Name: poly (ADP-ribose) polymerase family, member 6
  Uniprot ID: Q2NL67
  ENST ID: ENST00000260376
  CDS Start-End: 47-1603
gtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgg

SEQ ID NO: 166995 - DNA, 2625 bp, Homo sapiens
  Payload ID: 12876
  Gene Symbol: PARP6
  Gene Name: poly (ADP-ribose) polymerase family, member 6
  Uniprot ID: Q2NL67
  ENST ID: ENST00000287196
  CDS Start-End: 460-2352
caacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcagctgcatggagcagcctatggcaaaggcatctacctgagccccatctccagtatttcctttggatactcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgg

SEQ ID NO: 166996 - DNA, 1718 bp, Homo sapiens
  Payload ID: 12876
  Gene Symbol: PARP6
  Gene Name: poly (ADP-ribose) polymerase family, member 6
  ENST ID: ENST00000419739
  CDS Start-End: 60-1718
gtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcagctgcatggagcagcctatggcaaaggcatctacctgagccccatctccagtatttcctttggatactcaggaatgggaaaaggacagcacaggatgccctccaaggatgagctggtccagagatacaacaggatgaataccatcccccagacccgatccattcag

SEQ ID NO: 166997 - DNA, 2271 bp, Homo sapiens
  Payload ID: 12876
  Gene Symbol: PARP6
  Gene Name: poly (ADP-ribose) polymerase family, member 6
  ENST ID: ENST00000567440
  CDS Start-End: 388-1143
gtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggtgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctg

SEQ ID NO: 166998 - DNA, 601 bp, Homo sapiens
  Payload ID: 12876
  Gene Symbol: PARP6
  Gene Name: poly (ADP-ribose) polymerase family, member 6
  ENST ID: ENST00000567042
  CDS Start-End: 1-54
gtgatgtctattcgggagatgacccaggggtggggcagccacatggagcggtgaccatcctttgactcaaggctgtccctcaccagacttccccacccctcgtctgcaatctctgcatgaatagacattcatttgtactcatttacagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcagctgcatggagcagcctatggcaaaggcatctacctgagccccatctccagtatttcctttggatactcaggaatgggaaaaggacagcacaggatgccctccaaggatgagctggtccagagatacaacaggatgaataccatcccccag

SEQ ID NO: 166999 - DNA, 1950 bp, Homo sapiens
  Payload ID: 12876
  Gene Symbol: PARP6
  Gene Name: poly (ADP-ribose) polymerase family, member 6
  ENST ID: ENST00000567974
  CDS Start-End: 1-1694
aggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcagctgcatggagcagcctatggcaaaggcatctacctgagccccatctccagtatttcctttggatactcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatgg

SEQ ID NO: 167000 - DNA, 304 bp, Homo sapiens
  Payload ID: 12876
  Gene Symbol: PARP6
  Gene Name: poly (ADP-ribose) polymerase family, member 6
  ENST ID: ENST00000569890
  CDS Start-End: 1-220
tgtctgtactcgtgaactatgcgttttctccttctacacactgggcgtcatgtctggagctgcagaggaggtggccactggagcagagggctcatatttggaaatcaagaaacagatggacaagttggatcccctggcccatcctctcctgcagtggatcatctctagcaacaggtcacacattgtcaaactacctctcagcaggtgggtcccacattgagaactggcattcgatcctgcgcaatgggctggtcaatgcatcctacaccaaactgcaggaatgggaaaaggacagcacaggatg

SEQ ID NO: 167001 - DNA, 2855 bp, Homo sapiens
  Payload ID: 12876
  Gene Symbol: PARP6
  Gene Name: poly (ADP-ribose) polymerase family, member 6
  Uniprot ID: Q2NL67
  ENST ID: ENST00000569795
  CDS Start-End: 689-2581
gggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaacaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcagctgcatggagcagcctatggcaaaggcatctacctgagccccatctccagtatttcctttggatactcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 167002 - DNA, 2305 bp, Homo sapiens
  Payload ID: 12876
  Gene Symbol: PARP6
  Gene Name: poly (ADP-ribose) polymerase family, member 6
  ENST ID: ENST00000565443
  CDS Start-End: 224-1783
cacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatgg

SEQ ID NO: 167003 - DNA, 1876 bp, Homo sapiens
  Payload ID: 12876
  Gene Symbol: PARP6
  Gene Name: poly (ADP-ribose) polymerase family, member 6
  ENST ID: ENST00000564610
  CDS Start-End: 1-1354
ggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatgg

SEQ ID NO: 167004 - DNA, 516 bp, Homo sapiens
  Payload ID: 12876
  Gene Symbol: PARP6
  Gene Name: poly (ADP-ribose) polymerase family, member 6
  ENST ID: ENST00000569173
  CDS Start-End: 1-242
gggttgggcgcctcatgaaccgttccatctcctgtaccatgaagaaccccaaagtggaagtgtttggctaccctcccagcccccaggcagtggtcactgcaagaacattcccactctggagtatggattcctcgttcagatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 167005 - DNA, 740 bp, Homo sapiens
  Payload ID: 12876
  Gene Symbol: PARP6
  Gene Name: poly (ADP-ribose) polymerase family, member 6
  ENST ID: ENST00000565999
  CDS Start-End: 1-230
gagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgtaagtggggctagtacctgccaacaacatgtctagctggacttgtggaatttgtcatgtaggccaggagtcttgttcccgagtgctgtatttggagcacatattcttcatctctgtctttcctagaccatcagcagacagtggaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatct

SEQ ID NO: 167006 - DNA, 829 bp, Homo sapiens
  Payload ID: 12876
  Gene Symbol: PARP6
  Gene Name: poly (ADP-ribose) polymerase family, member 6
  ENST ID: ENST00000566844
  CDS Start-End: 751-829
ctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttc

SEQ ID NO: 167007 - DNA, 845 bp, Homo sapiens
  Payload ID: 12876
  Gene Symbol: PARP6
  Gene Name: poly (ADP-ribose) polymerase family, member 6
  ENST ID: ENST00000567263
  CDS Start-End: 1-373
actatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacatt

SEQ ID NO: 167008 - DNA, 596 bp, Homo sapiens
  Payload ID: 12876
  Gene Symbol: PARP6
  Gene Name: poly (ADP-ribose) polymerase family, member 6
  ENST ID: ENST00000568360
  CDS Start-End: 376-596
ctgccggccccaacctccggcgaggggactccctcccggcctacaggcaacctgggttgcccttcctgcttgttcctcccaaccactcggggcgctaaatgcaacacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaa

SEQ ID NO: 167009 - DNA, 2102 bp, Homo sapiens
  Payload ID: 12876
  Gene Symbol: PARP6
  Gene Name: poly (ADP-ribose) polymerase family, member 6
  ENST ID: ENST00000616176
  CDS Start-End: 47-1369
gtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggtgggtcccacattgagaactggcattcgatcctgcgcaatgggctggtcaatgcatcctacaccaaactgcagctgcatggagcagcctatggcaaaggcatctacctgagccccatctccagtatttcctttggatactcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgg

SEQ ID NO: 167010 - DNA, 7177 bp, Homo sapiens
  Payload ID: 12877
  Gene Symbol: PARP8
  Gene Name: poly (ADP-ribose) polymerase family, member 8
  Uniprot ID: Q8N3A8
  ENST ID: ENST00000281631
  CDS Start-End: 159-2723
ttctctcacccaggatcacttccgaaaccacttcgccttcagcccctgcctcggccagaggtttcatttttaactgaatatttacgaaagctggaagcgtgcgaggggggtggggtggggtggaaatagcggctgcttcttttccagggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggagggcaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattgaaaaaactgttttgtgctgatatttttatactaaactctttaactggatatttggtattatataccgacattttaggttaccaaaatagaattgagaacattttataatggcatctaaatctatcagatactttgcaataagtatactgtttgcacattctgatgtgctatatcattagtagtatgggcattctaatgttttggaaggggtgttccctattctatttttcttcataaaaaaagaagtaggtcttagaagcagtgctttgccaaaaagtatgtaatatacacatctatacattcatgcatcaaaatgtgtggttgtgaatatatttgtgtatattcacacgtatgttttgacaagaaagatggcttagcttcacaattctatcctcgtttaatggaaagaagataatatttagtaagcaataaatttggacataaatcaagatatgagccagatttaccaccattcattcactgaaaatatttgcagacaatttttctgtttgtctgaagaaattcagcccttttaaaatgttatctaaaagtcataatttggggaacatacatggcctggtagaccgaatctatattcaaatgattatgtatttaaaagaaagacctcagaatttaaagaaaccatatatattttttatttactacaaaaaaattatacaattttatttatgccacaccagcatttttatatttgttcatctaatatctctgcttatttttttcatattgagaaagaacacaaacttgatgcttcttttatattaaaagaccacaaataagtttatagagaacagtaacaccagctctcagcatttccttttcaagagtcataatttcatcaaaatcatttcttattctttgagtcctagagttcttattcatcaagttttaattgacagtgtttattttcccacatgttgtctttggaataaggccattcatgaaagcagtttaattagtgagtctgccactctattcaaaccctgaatcaaggctctatctgattttaatttatgtaaaaaaaaataaaaatgtatagtcatttgcaagtataatgtgataactgctgtgtttatttcctttgtctggcataaaaggtgagaaaaaggtcatacatgttgttaagggtagcagtttaggaagtgttttctaataatttgttttgttatattgcaaataattgatatgccacttatttctgcaagaaaaataggcttgaagtggttgggatattaatcattttgatagtatctacttaaagcattgatctgttttgacttgtggctctgaaccctgggctaggctgagggataatagtagtggagtagggcaaagatataatatcctatccagtgttttgtgaccacttatttgaagattagtgtgggacatgaggaccttgctacttttttgccaagatgctgcaagtctcccaaatcacttcaactgtgtttttaaaacatgtttaagcaacagaattatttttttgaaattagtctatacgttagacagtctatacatgacaaacatgaagatctaatatcaagatttgggagacgggatcttggaactccacctgtttgaccactaggaccactgaggcacctccaataagctctgtagagtgcctccagcataattcaaaatccactgacctaatccattatggctttacttaacattggagtgatccgtaaagaatatagtattggagtctgaactggaacggtaactcgtaagactcaagaaagaccgtttaaggaaaattggcataatacaaactgttcctgttgacttaagaataacagtaggttcacctatctgaggaaattaagtagttgatagtttaatgctaggcatcttttatgataataaagtaagatgtcttcttatgacagttaattgagttgtatcatgatacagaatgacagattttgtttcaaacaattgcgtcagaacctttgtaagcaaatattctaaggagaatcaatcttattttttaattgaactttttgaaattagggatactataataactgataaagatgaatttctgtgtttctaaagaatctaatttcaattactaccattaacatataaatgtgcttccaaaatccaagcaggtccatacaatttagagatttgaacactgttatcatgctttaattcagtcattcattaaaatattatctattcacttatttgatgattccaaacatttgatattgtattgtgtttttataattatttgaaatctgttcaccaatgctttgtaatggttttattaattgtgtagccattgctacttagatagtaacccactgagcaaaggcagtcatttattttcatccttgaagtaggggaagaaaattattaatttattagttctactttttcctgcattgcttattttgtaaacattttactatgaataatctgttctctttcactgtattaaaaggagaagaaaatgaacatttgagaatggaaaaaagtaataatatacaaataatctagtgctataaaatgcattatagtaagacacttttggtgtcttcgagtgcactatgttggaataaattttatacttgttgcttagtaaatctcagtcatacgtttggtttgaagctgtttttttttttaatttgaagtttaattttaaaagtgccacattgtaaaagttaccgttaaatactatgtagtataaaaaaccaacccaagctattgttaatgctctgaatgtttttctttgaaaatttaagtttagagaagaaattccttcatttttctcccctttgctaaaagaaagaaaatctataatatgtaagtctatgaatctttaaataactgaaggaattttagcagtactttgtataataaaaatattttttaaactataacttgccttagagcatggggtttcagaaagttttgacgaaaaactcatcttcattaaagagtctggataacttcatcagatggtaatttaatatgtcatgaaggggacactcaacattgggtcatctaccgtctaaataaatacggatttcatggtggcatttgaagcacattttgcaaacattatgatgttctattgtcttgctgaattctttattataacactacctcaagacaaatgatagactgttggtaaggtaaattgggttttcaatgtcaggaacaaataaaattttgcaaatagaagtcatcaaataattcaacaggaagaccatactggacacagatgttgtcagttacttctggacaatgtggtaacatggatatttcagtcactggtaacaatgtcagggttaacacccaatgaattatttgaaacaatttgggttgcaaaatttgaaattaattagtctattttgagattgattttctacgtgggccaattttatgtccattacctaaagccacaatctcccgctctaaggagttaaaggatgaaaacacccaactgctacactggaatggcagactggatattcaagcattttggcatttaatgcctgctaaatttttgtccgattatatatagatttgatgtatattattacccagtaaattcttcttgggaattttgtatacattatggaatattaggataagtttttgtaggtcagaagaatttcaagtagtttttagacaaaacatatccatgagtgtgaaaaaagctgtgttgacgaatagattacatttcacatttaccagcaagtcagtaaaaaatagtgcttatttacatagtcaatataatttaatgttctaaaaataatatcttcgatctgcccaatatttaatgtatcatttgagatttttaaaaatgcatccgctccattatgtaaacattaagatatgcctatgtttctttaactatacagcctctttacaataaatttcttgatttttgtgcacaggatagtattgcaacctgctatttagcctttggtgccttagaattattataaatatttaacaatatgtacataatgtaaatactgccaagagatcagtaaggccaaatattttctctattcactttttattgctcttgctttctattgctactaaagcctcttttatccagctttgtaatagttccaacattgtagcgaatgtaaatgtttactttcaataaatctgaacttgttcaacaagta

SEQ ID NO: 167011 - DNA, 577 bp, Homo sapiens
  Payload ID: 12877
  Gene Symbol: PARP8
  Gene Name: poly (ADP-ribose) polymerase family, member 8
  ENST ID: ENST00000503888
  CDS Start-End: 109-246
aagccaaacaggtttccatcttttaggaagaccctggaacgtgccagttgattctgaccatttctcatgaacagaaacacctaggaagggagaactgggatttatttaatggggatgtgttcaaggcaagagcgaattcagaaggatatcgacgtcgtgatccagaagtccagagctgagaaggactgcctgtttgcagtgtatcctactcagtacatgtatctgaagattacccagctattgtgaatactgccacaatgcacatggtggtggagatattgcttcaagatcctggttccgtttcctgtggatctcaaaaggattgctgaaatggataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggagggcaggtaa

SEQ ID NO: 167012 - DNA, 464 bp, Homo sapiens
  Payload ID: 12877
  Gene Symbol: PARP8
  Gene Name: poly (ADP-ribose) polymerase family, member 8
  ENST ID: ENST00000503046
  CDS Start-End: 116-464
ccctgcctcggccagaggtttcatttttaactgaatatttacgaaagctggaagcgtgcgaggggggtggggtggggtggaaatagcggctgcttcttttccagggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggtat

SEQ ID NO: 167013 - DNA, 554 bp, Homo sapiens
  Payload ID: 12877
  Gene Symbol: PARP8
  Gene Name: poly (ADP-ribose) polymerase family, member 8
  ENST ID: ENST00000507812
  CDS Start-End: 181-330
agcagtatctcatttctgaacacctggattgtagctttcccttgactgtcaaaggaggtggttttaaaaatcaagccaaacaggtttccatcttttaggaagaccctggaacgtgccagttgattctgaccatttctcatgaacagaaacacctaggaagggagaactgggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttatt

SEQ ID NO: 167014 - DNA, 2747 bp, Homo sapiens
  Payload ID: 12877
  Gene Symbol: PARP8
  Gene Name: poly (ADP-ribose) polymerase family, member 8
  Uniprot ID: Q8N3A8
  ENST ID: ENST00000505697
  CDS Start-End: 183-2747
agagcagtatctcatttctgaacacctggattgtagctttcccttgactgtcaaaggaggtggttttaaaaatcaagccaaacaggtttccatcttttaggaagaccctggaacgtgccagttgattctgaccatttctcatgaacagaaacacctaggaagggagaactgggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggagggcaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaa

SEQ ID NO: 167015 - DNA, 615 bp, Homo sapiens
  Payload ID: 12877
  Gene Symbol: PARP8
  Gene Name: poly (ADP-ribose) polymerase family, member 8
  ENST ID: ENST00000510303
  CDS Start-End: 92-367
atcttttaggaagaccctggaacgtgccagttgattctgaccatttctcatgaacagaaacacctaggaagggagaactgggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagtgtatcctactcagtacatgtatctgaagattacccagctattgtgaatactgccacaatgcacatggtggtggagatattgcttcaagatcctggttccgtttcctgtggatctcaaaaggattgctgaaatggataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggagggcaggtaa

SEQ ID NO: 167016 - DNA, 596 bp, Homo sapiens
  Payload ID: 12877
  Gene Symbol: PARP8
  Gene Name: poly (ADP-ribose) polymerase family, member 8
  ENST ID: ENST00000513738
  CDS Start-End: 130-531
acttcgccttcagcccctgcctcggccagaggtttcatttttaactgaatatttacgaaagctggaagcgtgcgaggggggtggggtggggtggaaatagcggctgcttcttttccagggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagcacattcctagactggcttcccagtgggtgtgagaaggctaaccagcagagaccagagctgtctgcttcctcattcacatctaggaggagcaagagacttcccacaggtagaatttcattcttgttgcccaggccgggtgcaatagcgcgatctcagctcactgcaacctccgcctcccaggttcaagtgattctcctgcctcagccttctactagctggcattacaggaattcagagcttgctccagggatgtgaggacaaaagatgagtatgacttttaaaaggaattcagaacttgctctagattttgctttcttctc

SEQ ID NO: 167017 - DNA, 513 bp, Homo sapiens
  Payload ID: 12877
  Gene Symbol: PARP8
  Gene Name: poly (ADP-ribose) polymerase family, member 8
  ENST ID: ENST00000515175
  CDS Start-End: 322-513
ggggctcgcccctcgccggcgcccgccgcccagccggtgattgctctctggctgtccccggcacctcggcccccacggccgttggtccgggcgggtgagggagaaagtgagacttggtgtcatcaccatccattgtcagaaggggaggaaattggaatccagcagcggcgagcagcagctgggcggtcacatctgggaatgcaaagccgacctccccctcctcctcctcctccccctcctcctcctcctcttctctcacccaggatcacttccgaaaccacttcgccttcagcccctgcctcggccagagggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagggaatatggagccattgatgatgtagatattgatctgcatatcgat

SEQ ID NO: 167018 - DNA, 3825 bp, Homo sapiens
  Payload ID: 12877
  Gene Symbol: PARP8
  Gene Name: poly (ADP-ribose) polymerase family, member 8
  ENST ID: ENST00000505554
  CDS Start-End: 18-2519
agcggcggcggccgggaatggagcctgctgcgctgcgctgcgcttatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggagggcaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattgaaaaaactgttttgtgctgatatttttatactaaactctttaactggatatttggtattatataccgacattttaggttaccaaaatagaattgagaacattttataatggcatctaaatctatcagatactttgcaataagtatactgtttgcacattctgatgtgctatatcattagtagtatgggcattctaatgttttggaaggggtgttccctattctatttttcttcataaaaaaagaagtaggtcttagaagcagtgctttgccaaaaagtatgtaatatacacatctatacattcatgcatcaaaatgtgtggttgtgaatatatttgtgtatattcacacgtatgttttgacaagaaagatggcttagcttcacaattctatcctcgtttaatggaaagaagataatatttagtaagcaataaatttggacataaatcaagatatgagccagatttaccaccattcattcactgaaaatatttgcagacaatttttctgtttgtctgaagaaattcagcccttttaaaatgttatctaaaagtcataatttggggaacatacatggcctggtagaccgaatctatattcaaatgattatgtatttaaaagaaagacctcagaatttaaagaaaccatatatattttttatttactacaaaaaaattatacaattttatttatgccacaccagcatttttatatttgttcatctaatatctctgcttatttttttcatattgagaaagaacacaaacttgatgcttcttttatattaaaagaccacaaataagtttatagagaacagtaacaccagctctcagcatttccttttcaagagtcataatttcatcaaaatcatttcttattctttgagtcctagagttcttattcatcaagttttaattgacagtgtttattttcccacatgttgtctttggaataaggccattcatgaaagcagtttaattagtgagtctgccactctattcaaaccctgaatcaaggctctatctgattttaatttatgta

SEQ ID NO: 167019 - DNA, 2730 bp, Homo sapiens
  Payload ID: 12877
  Gene Symbol: PARP8
  Gene Name: poly (ADP-ribose) polymerase family, member 8
  ENST ID: ENST00000515166
  CDS Start-End: 8-769
ttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggagggcaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagc

SEQ ID NO: 167020 - DNA, 2829 bp, Homo sapiens
  Payload ID: 12877
  Gene Symbol: PARP8
  Gene Name: poly (ADP-ribose) polymerase family, member 8
  Uniprot ID: Q8N3A8
  ENST ID: ENST00000514067
  CDS Start-End: 118-2556
gcccctgcctcggccagaggtttcatttttaactgaatatttacgaaagctggaagcgtgcgaggggggtggggtggggtggaaatagcggctgcttcttttccagggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggagggcaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcagaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattgaaaaaa

SEQ ID NO: 167021 - DNA, 574 bp, Homo sapiens
  Payload ID: 12877
  Gene Symbol: PARP8
  Gene Name: poly (ADP-ribose) polymerase family, member 8
  ENST ID: ENST00000503193
  CDS Start-End: 93-266
tttttaactgaatatttacgaaagctggaagcgtgcgaggggggtggggtggggtggaaatagcggctgcttcttttccagggatttatttaatggggatgtgttcaaggcaagagcgaattcagaaggatatcgacgtcgtgatccagaagtccagagctgagaaggactgcctgtttgcagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggagggcaggtgaactatgatggggaactgcacaagcacccacaactggaagctgatttgtcagcagttagagagatatatgggccacatgcagtttctctcaggtaaataagtatcactggt

SEQ ID NO: 167022 - DNA, 332 bp, Homo sapiens
  Payload ID: 12877
  Gene Symbol: PARP8
  Gene Name: poly (ADP-ribose) polymerase family, member 8
  ENST ID: ENST00000502524
  CDS Start-End: 101-332
ataaaagtgatggggggaggggcgcggagagggaaggctgggagccccagggagtcttcacgaccgctcagctcccggcgcgagtggagggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagtgtatcctactcagtacatgtatctgaagattacccagataatacatatgtgtcaagttcagagaatgatgaagatgtgctagtta

SEQ ID NO: 167023 - DNA, 576 bp, Homo sapiens
  Payload ID: 12877
  Gene Symbol: PARP8
  Gene Name: poly (ADP-ribose) polymerase family, member 8
  ENST ID: ENST00000503707
  CDS Start-End: 130-420
acttcgccttcagcccctgcctcggccagaggtttcatttttaactgaatatttacgaaagctggaagcgtgcgaggggggtggggtggggtggaaatagcggctgcttcttttccagggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacaggaatcaagacagaatagtacagtggaggaagattctgaaggtgacaatgattccgaagaattttattacggagggcaggtgaactatgatggggaactgcacaagcacccacaactggaagctgatttgtcagcagttagagagatatatgggccacatgcagtttctctcag

SEQ ID NO: 167024 - DNA, 572 bp, Homo sapiens
  Payload ID: 12877
  Gene Symbol: PARP8
  Gene Name: poly (ADP-ribose) polymerase family, member 8
  ENST ID: ENST00000503665
  CDS Start-End: 130-303
acttcgccttcagcccctgcctcggccagaggtttcatttttaactgaatatttacgaaagctggaagcgtgcgaggggggtggggtggggtggaaatagcggctgcttcttttccagggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaaggaattcagagcttgctccagggatgtgaggacaaaagatgagtatgacttttaaaaggaattcagaacttgctctagattttgctttcttctcatgtccaccttctttcactttcacttatgcttcttgacaatattttctgcctgctacatggcatttattatgtacagcacatactaacagtactctgcaatctacttaagctttgttctttccacgtttttttggtactactcattagatccttgagccaatcatccatgtctgtttgtactagattgtttcccttagaactct

SEQ ID NO: 167025 - DNA, 2384 bp, Homo sapiens
  Payload ID: 12877
  Gene Symbol: PARP8
  Gene Name: poly (ADP-ribose) polymerase family, member 8
  ENST ID: ENST00000514342
  CDS Start-End: 900-2384
ttctctcacccaggatcacttccgaaaccacttcgccttcagcccctgcctcggccagaggtttcatttttaactgaatatttacgaaagctggaagcgtgcgaggggggtggggtggggtggaaatagcggctgcttcttttccagggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggagggcaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcagaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagaaaacaaaaaaaaggacagcaatcccaattcctgcaaagccgtaa

SEQ ID NO: 167026 - DNA, 2809 bp, Homo sapiens
  Payload ID: 12877
  Gene Symbol: PARP8
  Gene Name: poly (ADP-ribose) polymerase family, member 8
  ENST ID: ENST00000503750
  CDS Start-End: 758-2239
agtcgggggcgcgccgcatcccctcggacgcggcgcagagggacctcgccgccctctagcccttgccttctgcccggccaggcctcccctgacaccaccgaatgtggggctcaagtcctgatcggggttaaaacaaatccactccaggggtagcttttgacgggactttctgtttcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacaggaatcaagacagaatagtacagtggaggaagattctgaaggtgacaatgattccgaagaattttattacggagggcaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcagaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaggacagcaatcccaattcctgcaaagccgtaacttaaaatgcatagccttatgtgaagatttcaacgagaagagatatattaagtcggaatggactaggattcctttagaataaagtggttctttaattttattttccacttaacagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattg

SEQ ID NO: 167027 - DNA, 3198 bp, Homo sapiens
  Payload ID: 12878
  Gene Symbol: PARP9
  Gene Name: poly (ADP-ribose) polymerase family, member 9
  Uniprot ID: Q8IXQ6
  ENST ID: ENST00000360356
  CDS Start-End: 229-2793
gggcttcgtgttcctgggtgctgaccgtgcactccccgccgcccgaggacttagagctctggaagtagctctccagcttccttcgtactcgggggccggacttgtacacccgcacgaggagcggggacggcgggcgcagaagtgggccaccatatctggaaactacagtctatgctttgaagcgcaaaagggaataaacatttaaagactcccccggggacctggaggatggacttttccatggtggccggagcagcagcttacaatgaaaaatcaggtaggattacctcgctctcactcttgtttcagaaagtctttgctcagatctttcctcagtggagaaaggggaatacagaagaatgtctcccctacaagtgctcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtatgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagtataaaaatgttaggataacagaatgattttagattttccagagaatattataaagtgct

SEQ ID NO: 167028 - DNA, 1837 bp, Homo sapiens
  Payload ID: 12878
  Gene Symbol: PARP9
  Gene Name: poly (ADP-ribose) polymerase family, member 9
  ENST ID: ENST00000492382
  CDS Start-End: 233-1432
gcctgccgggtgagtaggtccggtgcctctgggccctcggggtcccctctcctgcaggctcgaggtgggcggggagaagggggacgggcgcggacccgggtcccagggccaggcctcccttgtgagtagactatgcaaagaaaaagtgggccaccatatctggaaactacagtctatgctttgaagcgcaaaagggaataaacatttaaagactcccccggggacctggaggatggacttttccatggtggccggagcagcagcttacaatgaaaaatcagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtatgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagtataaaaatgttaggataacagaatgattttagattttccagagaatattataaagtgct

SEQ ID NO: 167029 - DNA, 6769 bp, Homo sapiens
  Payload ID: 12878
  Gene Symbol: PARP9
  Gene Name: poly (ADP-ribose) polymerase family, member 9
  Uniprot ID: Q8IXQ6
  ENST ID: ENST00000462315
  CDS Start-End: 295-2427
ctccctgttcccggcagagccgcttccccctcctccctgtgctgtctgcaccgaggagagcggcctgccgggtgagtaggtccggtgcctctgggccctcggggtcccctctcctgcaggctcgaggtgggcggggagaagggggacgggcgcggacccgggtcccagggccaggcctcccttgtgagtagactatgcaaagaaaaagtgggccaccatatctggaaactacagtctatgctttgaagcgcaaaagggaataaacatttaaagactcccccggggacctggaggatggacttttccatggtggccggagcagcagcttacaatgaaaaatcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtatgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcggtaggtgtcaatgcctcatcattggggctactctgtggaatttggtgagctgacatcagtagattcttccactgatagcatttgttgttgtggggaagggatcatttgtgactgtgatttagaggtcacaaatgatgacccaggtcacaaagtattttggaaagagtggtattttttacttttccttcgtatcttttgttgctgatgcattttacattgatgaaaagtgtgagcagtaagaactacggttcactgtttttctcctttatgtgtttctgtgtcctatccgcagagaacacgttgaggctttttttttttttttttgccttacttatctcaacaaaattattaccaacagcactgaaccgtcctcatcccttaattaaaagggcattttcccaaatttaagaaagttggtcttttctctttcatccctttgtttcctatagcctgctagtgaatgaattaggtatcatttggcaggtgaagtgcataacatcttaagatcctcttcatccataggagttctatgtgtaactcccatgtctcttttcagatgtacaaaaacattgcatatataattcttatattgccccctctactcctcagtcactaatgaagatttctggctttagttctctccaaaagaggaaaagaaatttagtaaaaattatggagagatacttagcggggtggcttgattttgcttggtctattaaatatgtggctcttgatctttatctttcaacatatgtagcatgatccttgctgaggagtcaattccaatagacttggtttctaggatgcaaaggctctagaaatcatcttttctttgttctggagagaacataggcaaaacttggggtaaatgttgaacatagacaattactggggataaaaatagagaaatgaatccctaccaagaagccttttggggcaatcaggaaagtgatgatcagtatagtcccttcattagcaaagtcttaaaaaatctataatttccatttgctcctaaagctggcttctctgcaatccccacccactacttctacttaaattactttcattaagatcatcgctgtgctcttactttccaaatctagtgagtattctcttttcagtcctgtgacagactctgctacttgcctacccaacatctatacacatctttcttactaaaacatctaagacacccactatcctcccaaggaatatggtcccaaggtcttagccagactcatcatcagctcaagttcaggcagttctctctttatttatttatttatttttctgagacggagtcttgctctgtcactcaggctggagtgcagtggcaccatcttggctcactgcaacctccgcctccgagattcaaacagttctcctgcctcagcctcccaggtagctgggattacaggcatgtgccaccacgtgcagttaatttttgtattttttttagtagagacgaggtttcatcatgttggccaggctgatctccagctactcgtgatccgtccacctcagcctcccaaagtgttgggcttacaggtatgagccaccatgcccagcaggcagttctctcttaaagcttaaaggcaagatactgcccccaacatactcattatatagtgatataaaaaggagcgggaaaactgcaatgaaaactctcatgttgaaaggggagaagcaaaacacacaacagccactggctcacaccacttatctacatgctgccgaacaggtatagagaggactccctattccatgttgtaaaacctttattttgcactctgggaaaatcttccttatatattgtggcccttggctatttccaggttcattgcctatcagggagccatggattttctcacaggctagaatgtgctcaggctgttgcaaccaggcttgtggtttcttcagcaatacagttcctttaaaaattcagtgggcacgaggcctaatttcttctggttaagtttatgtctttataacctaaccacagatcttgtctccatatagtctttcaactcaagattttggtctcttacctgctgtctgtgtgctctgcccttctccctatcccttagcttaacagccactgccttgaggcaattcagacatgactcataatgtgacctgcaccaattgactcatctctgtaggctagagagaactcttaacagaaggtgccagacaagcccaggagacaccaatcttgctaccactgaagctgttgttatttggagtacaaaagctcttagctttttcagccgtgcaatattccaaattataggactctcagtcaatttagatggccacccacaggcaaaggagacagaacttctgttaacaaacctttattttcttttttctatttatgtttgcattccaaccagttctgaataaatctcttgcttgtaggacttggttgagtgcagcaagaaggcatctacacatgcagtttcttactgggttgattcatttgttccacaggtatttattaagcacattctatgaatcaggccctgtgctaggggtactagaaatagagtgtaaataaaaaaccatagagttcttgcccttacaatttataatctcacgagttcacctgttgcccattctttatcttctctcttttttcctctacgatgtcccccttggtgatggcacctgttcccatggcctcaactcctacctcaatgatgacgacttaggaatttctaactcttaactccctacctctctcctgacctgcaggttcatatgtctcactctctttttgacatctttacccagatgtcccataggtaactcaaattgatcccttttcttggtcatgattttccctaagaaatatgccctttgtttgctgattctccctaacctggttagtatcatcaccatctacctaccaggtttcctaaggctgaaacattatcatcctccattcctccttttccctcacccttatacccaggcattcacccagtcctagtgattcactctcatgaagatctcagcccagtttcacctctctattcctactgccttagttaatcttccttcagacctagactattactaggtcctctccttgccacaaaacacacccctacctaatctatcctttaccaccagaattatcacgctaaaaattacattcttgcttaatatctgtattcccagttgcctacgggataaaagcccaaactccttagcagagaatataaggccctagctcccacattatttcagcagtcatcacccactatgttcctcaagactgcagccattaactttttagagttccctaaacatgctgtttactttcatgcctctatcccgttgtctgtggaatgacttccctccttgcccttttcagtgctacaaacccctattctttaagacatagtacaaatggcatctcctggttggcatctttcctgcaggcctacaggcctagtaagtatcttcctcctctgtgctcctgcatacctccattcctttgttatgacatctataactttaataagtactaaaatctgtagtcctacaaaactcaggcatagaactcatttcctttatggctctataatggaactttacccaactctcacgttccccatgaccacagatgtggaaaatttgaatcttgacagttcaaggtgaactcagtcattttcagagttttcatagtcccttcaagattgaaactcagttcctgcaatgtttgccccttttctcctcttttgtctatgctgggagaggcattgtggggagggttgtctggcttatggctcccattgtcctctgcttgataaaccacctgagctttggtcattagcagtctcctgtgcctttcacactcaggtagtgtctgcacaggccactctatgtcttttccatgctgaagaaattcctttccaggccatgtctgtgttcctcctgccacacaggaaatttttgagcatgttcatcctccaagctgaatgcagggtcttgggtagtggtcctcacctgctccagagacttctccagccattgccactctccactcaggtgatgaagctggatgagggactgcacccaccagagtcaggccagggtcctgtctgctctgtgagtccctccaattgttcttattccgagatttccattgttctgccccctcttgactcccagggctctcaagggagtgggggtagtgaagggagccctttcccaagctcccccaagagctctagtcacatcacttctgatacttcttttcccaccagctggaagaaagaactttcatttgtcttgaaatgagaaaaatgttcttagaatattttgtattactctctgctctgtcatttatggtaaacaaaataaaataataaaaaaaaacaaccc

SEQ ID NO: 167030 - DNA, 3040 bp, Homo sapiens
  Payload ID: 12878
  Gene Symbol: PARP9
  Gene Name: poly (ADP-ribose) polymerase family, member 9
  Uniprot ID: Q8IXQ6
  ENST ID: ENST00000471785
  CDS Start-End: 222-2681
gagtaggtccggtgcctctgggccctcggggtcccctctcctgcaggctcgaggtgggcggggagaagggggacgggcgcggacccgggtcccagggccaggcctcccttgtgagtagactatgcaaagaaaaagtgggccaccatatctggaaactacagtctatgctttgaagcgcaaaagggaataaacatttaaagactcccccggggacctggaggatggacttttccatggtggccggagcagcagcttacaatgaaaaatcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtatgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagtataaaaatgttag

SEQ ID NO: 167031 - DNA, 3128 bp, Homo sapiens
  Payload ID: 12878
  Gene Symbol: PARP9
  Gene Name: poly (ADP-ribose) polymerase family, member 9
  Uniprot ID: Q8IXQ6
  ENST ID: ENST00000477522
  CDS Start-End: 229-2688
gggcttcgtgttcctgggtgctgaccgtgcactccccgccgcccgaggacttagagctctggaagtagctctccagcttccttcgtactcgggggccggacttgtacacccgcacgaggagcggggacggcgggcgcagaagtgggccaccatatctggaaactacagtctatgctttgaagcgcaaaagggaataaacatttaaagactcccccggggacctggaggatggacttttccatggtggccggagcagcagcttacaatgaaaaatcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtatgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagtataaaaatgttaggataacagaatgattttagattttccagagaatattataaagtgctttaggtatgaaaataaatcatctttgtctgattaa

SEQ ID NO: 167032 - DNA, 567 bp, Homo sapiens
  Payload ID: 12878
  Gene Symbol: PARP9
  Gene Name: poly (ADP-ribose) polymerase family, member 9
  ENST ID: ENST00000466126
  CDS Start-End: 222-567
gagtaggtccggtgcctctgggccctcggggtcccctctcctgcaggctcgaggtgggcggggagaagggggacgggcgcggacccgggtcccagggccaggcctcccttgtgagtagactatgcaaagaaaaagtgggccaccatatctggaaactacagtctatgctttgaagcgcaaaagggaataaacatttaaagactcccccggggacctggaggatggacttttccatgaaagtctttgctcagatctttcctcagtggagaaaggggaatacagaagaatgtctcccctacaagtgctcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatg

SEQ ID NO: 167033 - DNA, 2782 bp, Homo sapiens
  Payload ID: 12879
  Gene Symbol: PAIP1
  Gene Name: poly(A) binding protein interacting protein 1
  Uniprot ID: Q9H074
  ENST ID: ENST00000306846
  CDS Start-End: 234-1673
ctggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccaggtgctggtcggggccggagccggggcctgggccgcggagggggcgggcctgagggcggcggtttcccgaacggagcggggcctgctgagcgggcgcggcaccagccgccgcaacccaaagccccgggcttcctgcagccaccgccgctgcgccagcccaggacgaccccgccgccaggggcccagtgcgaggtccccgccagcccccagcggccttcccggcccggggcgctcccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcttctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaaggctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaa

SEQ ID NO: 167034 - DNA, 1814 bp, Homo sapiens
  Payload ID: 12879
  Gene Symbol: PAIP1
  Gene Name: poly(A) binding protein interacting protein 1
  Uniprot ID: Q9H074
  ENST ID: ENST00000338972
  CDS Start-End: 428-1531
acattttcttgaaatttctggaggggaaggttaacgggaagagaacgaagcttgttaaacgtaggtgtgacctactgtggtaaacacctagggtgaattaaagaggggacacatattttgattccgtttctactcccttcccccgatgctaacggagcaggtgacagtctcccagggaccactcctcagcagtccgcgggtctcggccggagccgagtcattgaacacacctgtgcgccagcgaaccctggcgcagggtccacgccccctccccccgtgtttttatttcccgggcgtcaactgtcggtctcgcacgtctctcctgagaactaccgagtaggtcgggcctgcctgtgagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaatttt

SEQ ID NO: 167035 - DNA, 1734 bp, Homo sapiens
  Payload ID: 12879
  Gene Symbol: PAIP1
  Gene Name: poly(A) binding protein interacting protein 1
  Uniprot ID: Q9H074
  ENST ID: ENST00000436644
  CDS Start-End: 248-1450
gttttgggggagaactggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttg

SEQ ID NO: 167036 - DNA, 1766 bp, Homo sapiens
  Payload ID: 12879
  Gene Symbol: PAIP1
  Gene Name: poly(A) binding protein interacting protein 1
  ENST ID: ENST00000504639
  CDS Start-End: 208-1008
ggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccaggtgctggtcggggccggagccggggcctgggccgcggagggggcgggcctgagggcggcggtttcccgaacggagcggggcctgctgagcgggcgcggcaccagccgccgcaacccaaagccccgggcttcctgcagccaccgccgctgcgccagcccaggacgaccccgccgccaggggcccagtgcgaggtccccgccagcccccagcggccttcccggcccggggcgctcccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtcacatctataccaaattaaggatgttgagttatgttactaatgtatgcaactttaattttgtttaacactatctgccaaaataaactttattccctataacttaaaatgtgtatatatatataatagtttattatgtacagttaattctact

SEQ ID NO: 167037 - DNA, 1603 bp, Homo sapiens
  Payload ID: 12879
  Gene Symbol: PAIP1
  Gene Name: poly(A) binding protein interacting protein 1
  ENST ID: ENST00000514514
  CDS Start-End: 232-1287
ggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaata

SEQ ID NO: 167038 - DNA, 726 bp, Homo sapiens
  Payload ID: 12879
  Gene Symbol: PAIP1
  Gene Name: poly(A) binding protein interacting protein 1
  ENST ID: ENST00000515338
  CDS Start-End: 442-726
tattttcattggacagcactgatgcaagatgaaaaagagggcagagttacactgaaaggtagcacattttcttgaaatttctggaggggaaggttaacgggaagagaacgaagcttgttaaacgtaggtgtgacctactgtggtaaacacctagggtgaattaaagaggggacacatattttgattccgtttctactcccttcccccgatgctaacggagcaggtgacagtctcccagggaccactcctcagcagtccgcgggtctcggccggagccgagtcattgaacacacctgtgcgccagcgaaccctggcgcagggtccacgccccctccccccgtgtttttatttcccgggcgtcaactgtcggtctcgcacgtctctcctgagaactaccgagtaggtcgggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacag

SEQ ID NO: 167039 - DNA, 706 bp, Homo sapiens
  Payload ID: 12879
  Gene Symbol: PAIP1
  Gene Name: poly(A) binding protein interacting protein 1
  ENST ID: ENST00000511321
  CDS Start-End: 106-706
caagatgaaaaagagggcagagttacactgaaagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatgg

SEQ ID NO: 167040 - DNA, 752 bp, Homo sapiens
  Payload ID: 12879
  Gene Symbol: PAIP1
  Gene Name: poly(A) binding protein interacting protein 1
  ENST ID: ENST00000508537
  CDS Start-End: 248-752
tggggggaggggccgggtgcgcggtctcggagttcggggtcccgggaggaagtaaaaatcgcctcccctcagcagccctctaaagcgagaccctagcgagtaaccacctcttttccaccgacccctttaaaacgacagagaggaaaaaagctcgcaagcactcatttgagaggcagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacc

SEQ ID NO: 167041 - DNA, 515 bp, Homo sapiens
  Payload ID: 12879
  Gene Symbol: PAIP1
  Gene Name: poly(A) binding protein interacting protein 1
  ENST ID: ENST00000514816
  CDS Start-End: 1-150
aatgaaccaacattttatacatctgatggtgttcctttcactgcagctgatccagattaccaagagaaataccaagaattacttgaaagagaggacttttttccagattatgaagaaaatggaacagatttatccgggatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaatttt

SEQ ID NO: 167042 - DNA, 501 bp, Homo sapiens
  Payload ID: 12879
  Gene Symbol: PAIP1
  Gene Name: poly(A) binding protein interacting protein 1
  ENST ID: ENST00000504075
  CDS Start-End: 473-501
ggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccaggaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtc

SEQ ID NO: 167043 - DNA, 1459 bp, Homo sapiens
  Payload ID: 12880
  Gene Symbol: PAIP2
  Gene Name: poly(A) binding protein interacting protein 2
  Uniprot ID: Q9BPZ3
  ENST ID: ENST00000265192
  CDS Start-End: 176-559
gaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaa

SEQ ID NO: 167044 - DNA, 2297 bp, Homo sapiens
  Payload ID: 12880
  Gene Symbol: PAIP2
  Gene Name: poly(A) binding protein interacting protein 2
  Uniprot ID: Q9BPZ3
  ENST ID: ENST00000394795
  CDS Start-End: 992-1375
ctggggtttggggagagaggggcggagggactggcgggctcttggcgtcttgggggaacgctgcaaccgtcgacgggcctgatcagaagatcgtctttctcccgtttcttcgccatcgctaccccttatttttggttgtattgcagctcatgccctggaaaaaagaacctttggggtactgggaacccttaccctaggagggcgttgagttagatgaactttaaggtcctcttaccttttaataattttctgtgcttactctcctccttccccaccatcgccaccagaaataaataaggcttgtggtgaacttaggtcttcaaaacatttgttgcagcagccagcagtgatattttttagggactcctaaaaggggtcttacctgcttccttttgtttcttttttccctgatttggcacccgtatcaactcataaaaaccccaaactctagaaagaatttggcttccaatttgccttggaaggtgtagcagctgacagcctttgacgtttatttcaacggaaagtagatgttcatgttgggtgtgctggctaatgttgaaacgtggtggcattgttttttcacagatttcattagcacagttagatcaggtgttggtttatattttcattaagtcgcttttgaaatttcttctggcgtaggttgtgtttgcaataagtaaaagttctctacaataatttttaatgagactccactatttgcttttgtgattctgtttccagttagtgaaagacaggatatttggggaaaattagtctgtttatactacttgtcagttgtgaacttgaataaaactttttcacacacacacaaaatcacaggataggtaacttgacaagaactatagaacccacttgtgtttctttaagggatggaggttagggaatggagatttcctctaatgattcaaggctgtgcacgttgctccttaggaactcaaattgaggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgagca

SEQ ID NO: 167045 - DNA, 858 bp, Homo sapiens
  Payload ID: 12880
  Gene Symbol: PAIP2
  Gene Name: poly(A) binding protein interacting protein 2
  Uniprot ID: Q9BPZ3
  ENST ID: ENST00000510080
  CDS Start-End: 193-576
ggggagagaggggcggagggactggcgggctcttggcgtcttgggggaacgctgcaaccgtcgacgggcctgatcagaagatcgtctttctcccgtttcttcgccatcgctaccccttatttttggttgtattgcagctcatgccctggaaaaaagaacctttggggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaa

SEQ ID NO: 167046 - DNA, 468 bp, Homo sapiens
  Payload ID: 12880
  Gene Symbol: PAIP2
  Gene Name: poly(A) binding protein interacting protein 2
  ENST ID: ENST00000511706
  CDS Start-End: 130-333
gcggcgggcgaagcgcacgtcgagcgggggagcggcgctgcctgtggagatccgcggaggccgacaggattcgttggctgccgtccccgctgctgtgcattgggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaagtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcat

SEQ ID NO: 167047 - DNA, 776 bp, Homo sapiens
  Payload ID: 12880
  Gene Symbol: PAIP2
  Gene Name: poly(A) binding protein interacting protein 2
  ENST ID: ENST00000507755
  CDS Start-End: 498-776
ggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggaagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattggggatggaggttagggaatggagatttcctctaatgattcaaggctgtgcacgttgctccttaggaactcaaattgaggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgac

SEQ ID NO: 167048 - DNA, 6279 bp, Homo sapiens
  Payload ID: 12881
  Gene Symbol: PAIP2B
  Gene Name: poly(A) binding protein interacting protein 2B
  Uniprot ID: Q9ULR5
  ENST ID: ENST00000244221
  CDS Start-End: 168-539
ctggcaagtggtagtggcgcttctcgggtgctgtgcttcacgttttggtactaaaggccgagactgttgtggcgacggcgacctctacggcaacggcttaagctctcggaggagtggcagagtacgatctgaaggaggggcttctggttagcccaggttccatcataatgaatggatccaatatggcaaatacatcaccgagtgtaaaatccaaagaggaccaggggttaagtgggcacgatgaaaaggaaaacccatttgcagagtacatgtggatggagaatgaagaggatttcaacagacaggtggaggaggaactgcaggagcaagacttcttggaccgctgcttccaagagatgctggatgaagaagaccaagactggtttattccctcacgagacctgcctcaggccatgggacagttgcaacagcagttaaatggactgtcagtcagtgaaggtcatgattctgaagatattttgagcaaaagtaacctgaacccagatgccaaggagtttattccaggagagaagtactgagccgagaaagctttgaggaagacttgtctgtccccacatctggggatagtaatgcacaaaatggtggagctgaagagggggatggggcgggcgaggggtgcacagcgggaaggggagtggtggtctcacaatactgtgactctgagtaactaatatgctcagtcttattctaagcctctgagtatttctattttgttctgctgacttttgtttggggagtttcctgttttgtttttttaaatagctctttcgagttaaggaaattgcattttccccccttcatcagaagtgttccgcggtgtgtatttaaacaaaataagctgactaagaaaaactggatatttaggaaatgcccctctcaccctgctgtatacttatcagggacagtgagcacctggagagctttttgtggaatctattgagttggatgggaaaagggacaagcagaaagagcaggtggtgcaaactggaatttgaggctcagctgccccacccccggggtctcctgcaatgaactcggataaccaatgtgctgtcaagcccttgcctgtttgtcctgaaccccattcaagaaaacacagacttaaagtacttagtttacagtaacttttgatgattgttgaaagttgtaaatcagaaggtagggctgtgatggtggttgtcacttgagtcatttagttactgttgtcctgttcataagcctgtgttcaccaccaccatcagactcaccatttataagtagaagagcactagggttgatctgccacctcatctttcatgaagtctattccccagcctcctttttaagaaaagatactgctaccaaaggcataggggaggcctgctgtgctggcaattagcatgagcctgcagaagtcatccttgaatctgttgtgtcttaattttatttggacagtttttttttccagcctcatcaacacttggtcttcctggtgtcttaattccctcagacaagtttatgcacttttttaaggaaatatttttcaggacactagtaagaagctcagttcacagtttggatatttcttcccacattacagaattatggaaaggaactcaaaatcagcctaggaaagtgagtcctgcttgacccatgtgactgtgtacctgaccttctgggatcttttcagctattaaaacattttactgttcccacatacccagctttgcaagttttgtagattgacctcttagggtgtgtttctttgtctttcctgcctttaacttgctggggtcttttgttgctacccctaaggaactaaactgggtgccaggagctaccttcgtgtatagagatgtagatggcagtgtggggtacaggagagccatccaggccattctcccagggatgaggaattggagagccctgaagataatagtggcttctttctgattgctactgtgctgtgtgataggcctaatagggaaaagatatgtaacttgaaacaaagttggtataaattcagtatgtggctgtgggacagaggttggaaggaaaggactagggtatggaaagctgaagaaattctccttatgagctctcgttgactttttgaacagtgataagctaatgccagatttaaaatacacattttttcctatttgagtctttaggattatatcatttgaaaaaattgccttccttgttaggtcacatgtcataggagagtagcttagagaacttgcattaccagacagacacattaattcccaaagcctctatgttgagagaatgaaactgttaactctttttcagagaggactatgaataaagaaacttctttattcaagcttcagctttcagctgggttgtttcctctaaaagggaaagggcattgcaagtgcatagaggaaatctctcccttctgggactgcttttcctccttcatcctcgtgagcctgtccaagctcagaattccgaaggctgttagaaatgcgttgggattgcagagagaaaggagcttgtctttccttctgctgtgctggtctgttttggatgtcagtcttcaggactatgaaaacttcctgccagtttagcatggacactgagggctggcatttctagtcttcttcagacactgaacatactgactccaggtataggaagcagctagcaaattgattcttttttaaatgcataggactctgcttccggcggttcctcttgtagtccaactctttttgccatctatttatgttgggaggtaggggcacaattgtcactcacaacacaggctagttagagtttgctaccttcttagcagaaaatgcatgtgtgtcttgttggaccttcactggggaaaggctgggagcctctggctgtcagtgacttttctcacagaagaagaaccagcaagccagactggacacctttaccctttaatggtaagacttgtatttataaggggtaattttgatgttgaatttaagccactactttgtttaaacttttttaaattggcaactagaagtttgagaatttgtatagaaatggaacatgtatttctaacagttgccaatctggctggtcccaatgttagtttattagtgattgatctgtaattattgggattatttattcaactctaaaattccaagatgaaaataatttatctctttcttttcaagggaaaaaacccaaatgaatgcattttcagtttctccaggcctttgaactgcagcagaaaattcaaggatacagcctaggcctgggcaaatgcagccctgggtctttgggccagtttctgacaataatagttgagttttgggaatcacataagggtgaaaccagaaacgatcctaaggaaaggcttgacctttgttaacacctttagtttccaaagtcacagcagctggggtccctcttttttttttttttttctttttttttgagacatagtctcactctgtcacccaggctggagtgcagtggtatgaccatagctcactgcagcatcaaattcctaggctcaagcaatcctcccatcttagcctcccgagtagctgggacaacaggtacgcaccaccacggccagctaattatttttattatttttattttttgtagagactggatcttgctctatttcccaagctactcttgaattgttgtgctcaagtgattctcccatctcagcctcccaaagtgctgggattataggctgggtgtggtgagccaccccagcctggggtctctttaattaaggttataatgctaaccatggcttaaaatactaagcaacattttccaaattgtttattactattgctttgattttggagaagctgggaagtaaggaggtgaggtgaatactctgataattaacacgtgttagagaggaaagttgtgtgaagaggctgccaaagtaaacagcacgaatgaatcttcttgtactagggctgctgcaaaccccaggtagacaaatgacagcccaggctcctgaaccatcaggaacccaggaatctacccaactgtgaggagggggcaggccttcgtcaataagggtcccaccatcacgggctaataatctttctcagtttaggtgatattgaggtattgaaactgttagaaatctgacagatttgaccaagatttggagacgtccacataattgggaaggactgagtgtccctagccactctcctctgggataacgcggacgtcattagtttgcgaagtgggtggggagaacaggaggattgactctaatttggtgtgtagtgggggccttgatgtccttctgcctctgtccacatttccccatgtgactcattgcaccctgcattgctcacagggatcattagttctcccggtagacagagcacctctgcagcctctgctctgctgccttgtgaatttcctacacagacttggttagttacaatttggaaacagtttttttgggtttttttcctttgttttaatcttctcacaatgaagctgctattggtgacagggacaggggagcaggaagccaacccagggaaacatgcgagtttcctgcacaccacttagtcacctgccctcactggccaaccccctactgctgttcccagtcagtctggtttttagaggcatcgtggcaatagaatagctggatacactaatctctacaaggtgtcaggcaggagattcaccttccccagtcccaggggacaggagagaaatctgtaaagggacagatgcaccatctttatttcaaaagaaaaagctccctcagattgtgttactaggagtctcttttgtgacatttactgagctttctccccaatcttaccttcctattggctactttttaaataaaaataaacattttaggctaatatgacaaaaatgagataaaatcttaaaaacattgtactagtgtacagttactaaaatgtgcttactacaaaacagtaaaatatttcactctgtaaatcatcactaagtagttattctgtcctgttgattatgagcctccaaaaatgtttaatgcttgaaggatggtttgggaggcagggaatccttttcttaaaacaactttaatgaggcatatgttacatatcataaaacacccatttcaagtgtacatttcagtgattttagtaacttccctcagtggtgtagctgtaactattactcagttttagaacatttttatccctcccaataagatccttcatgctcttttacagttaatcctgttcttacccccggcaaccactaatctactttctctataaatttgccctttctggacagttcaaatcaatggaatcatacaatatgtggtcccttgggtctggcttttttacttagctaatgtttttgaggtttgtccatgacagataacgtcttggtagtttgttccttttattgctgagtagaattctgttgatggatgtaccacattttgtcagcagagagccttttaaacttggattccaacttcctgttgtctaaacggaaccctccgaacgtaggacttataggggaagctgctgtgcatgtcaaaaaaactactaatcagaatgagctttgtcatccagagccagaactgctgcagaaatttttataattttgcaacttctttttttacaaggaacttttgtgctactacacatcaggacttttgaagcatccaataaatccatttaataagtatgagcatgtgtctgagtggacaagaaagtgaaaccatccatgctacattggataatttttcctcccccagactggacagggaatctcagctttcaaaacagagtaacctggctccacttacaaagctgcacaggcattaaagatcgtgctgcctttgttaggcagatttggaggggaggcccaacagcaaagatggagaggaaaaagggagtggagcttgtggaacaggaagccccccagggtctgtgcagggctgctcagctcttgaggatgttgtggatggtgaagtggtgatggtgtcccggagcagcccagcacctccactgggcccagaaggtcttgacttcggacacttacccctgtttcacaagtgtttataaagctgtttttgctttttttcccctaatcattacttggtagttattaatccttctttgggggagggacagggctttaaaactgaagaaaataattttcataaaaatatcaaaaatggaaaaaagttactttgtaaaaaatttgctatacaaaccaaatggcagctgttgagaatctcaataaaatgttaaatgc

SEQ ID NO: 167049 - DNA, 3485 bp, Homo sapiens
  Payload ID: 12882
  Gene Symbol: PABPC1
  Gene Name: poly(A) binding protein, cytoplasmic 1
  Uniprot ID: P11940
  ENST ID: ENST00000318607
  CDS Start-End: 1130-3040
cgtagtgcggtccgggtaggagagagcagggggccacgctggctccatctacgcacgtttcggaaaccgggcccggaggggaccacgcccgctcacccgtgcccggcgtcccccggagctggggctagaggagccgggccggccgcagcgggaagaggccacaggcggccgcgcacgtggggggtggttagcgcggaggaacccggaagccctttgcaccgcccaccgccgcggtgacgggttaacgctcctcctggtggaggcaggggcgggcggggcggaaggcggggacgcctcagccaacacccccgaggaccgcccgcgagccgtcctccccacccccacggacgcgacgcagcgcgggctccgcttccccggccgcggcgcctgcgcaaaagccccgccccttcgcccgagccccacccccacaccgcagcctccaccgccgccacctctcccttcctctctgctctttcctcctgttttctcttccctcctccccctggcctccgcgtctcctcctactccggcgctgacgctcgcgtaggggccctggcgtcagacgcgcgggggcggggcgagtgcggcgcggggtataagtagagggtgcaggaggcggtgcttccccttctccccggcggttagtgctgagagtgcggagtgtgtgctccgggctcggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccattccaaaatatgcccggtgctatccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaaattgatcagggaccatgaaaagaaacttgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaacaaaaaaacacaaaaaaatagtaaaatataaaaacaaattaatgttttatagaccctgggaaaaagaattttcagcaaagtacaaaaatttaaagcattcctttctttaattttgtaattctttactgtggaatagctcagaatgtcagttctgttttaagtaacagaattgataactgagcaaggaaacgtaatttggattataaaattcttgctttaataaaaattccttaaacagtg

SEQ ID NO: 167050 - DNA, 667 bp, Homo sapiens
  Payload ID: 12882
  Gene Symbol: PABPC1
  Gene Name: poly(A) binding protein, cytoplasmic 1
  ENST ID: ENST00000519622
  CDS Start-End: 1-394
tgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctc

SEQ ID NO: 167051 - DNA, 851 bp, Homo sapiens
  Payload ID: 12882
  Gene Symbol: PABPC1
  Gene Name: poly(A) binding protein, cytoplasmic 1
  ENST ID: ENST00000519100
  CDS Start-End: 1-851
aggtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacag

SEQ ID NO: 167052 - DNA, 971 bp, Homo sapiens
  Payload ID: 12882
  Gene Symbol: PABPC1
  Gene Name: poly(A) binding protein, cytoplasmic 1
  ENST ID: ENST00000520868
  CDS Start-End: 1-509
cagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaagtgagcttttccctctgattgatcagggaccatgaaaagaaacttgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaacaaaaaaacacaaaaaaatagtaaaatataaaaacaaattaatgttttatagaccctgggaaaaagaattttcagcaaagtacaaaaatttaaagcattcctttctttaattttgtaattctttactgtggaatagctcagaatgtcagttctgttttaagtaacagaattgataactgagcaaggaaacgtaatttggattataaaattcttgctttaataaaaattccttaaacagtg

SEQ ID NO: 167053 - DNA, 487 bp, Homo sapiens
  Payload ID: 12882
  Gene Symbol: PABPC1
  Gene Name: poly(A) binding protein, cytoplasmic 1
  ENST ID: ENST00000517990
  CDS Start-End: 1-411
ccacgtcctgcagctgcagccgctgcagctactcctgctgtccgcaccgttccacagtataaatatgctgcaggagttcgcaatcctcagcaacatcttaatgcacagccacaagttacaatgcaacagcctgctgttcatgtacaaggtcaggaacctttgactgcttccatgttggcatctgcccctcctcaagagcaaaagcaaatgttggccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaaattgatcagggaccatgaaaagaaacttgtgcttcaccgaagaaaaatatctaaacatcgaaaaacttaaatatt

SEQ ID NO: 167054 - DNA, 560 bp, Homo sapiens
  Payload ID: 12882
  Gene Symbol: PABPC1
  Gene Name: poly(A) binding protein, cytoplasmic 1
  ENST ID: ENST00000517403
  CDS Start-End: 1-560
tcaatggaaaacaaatttatgttggtcgagctcagaaaaaggtggaacggcagacggaacttaagcgcaaatttgaacagatgaaacaagataggatcaccagataccagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccattccaaaatatgcccggtgctatccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacag

SEQ ID NO: 167055 - DNA, 493 bp, Homo sapiens
  Payload ID: 12882
  Gene Symbol: PABPC1
  Gene Name: poly(A) binding protein, cytoplasmic 1
  ENST ID: ENST00000520804
  CDS Start-End: 363-493
ttctgcggccgacgcgcgtggcggcggtgccggctgggactcgtagtgcggtccggcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcag

SEQ ID NO: 167056 - DNA, 736 bp, Homo sapiens
  Payload ID: 12882
  Gene Symbol: PABPC1
  Gene Name: poly(A) binding protein, cytoplasmic 1
  ENST ID: ENST00000522658
  CDS Start-End: 1-552
atccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaagtgagcttttccctctggtttgttgttttaagcttgttttcttcatcttttataaagtttgttgagcatattttgaaatgtacatagcaaaagatcattttacagttcatttaaatgtattgctaatttttcaaggaaaagtggaactaactatagaggaattaaaggaattttacccgttaa

SEQ ID NO: 167057 - DNA, 492 bp, Homo sapiens
  Payload ID: 12882
  Gene Symbol: PABPC1
  Gene Name: poly(A) binding protein, cytoplasmic 1
  ENST ID: ENST00000521067
  CDS Start-End: 310-492
gttggtgtcagcgagcgccgcggccgttggggactccagctcccagcaggcaccgcttctgcggccgacgcgcgtggcggcggtgccggctgggactcgtagtgcggtccggcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcag

SEQ ID NO: 167058 - DNA, 818 bp, Homo sapiens
  Payload ID: 12882
  Gene Symbol: PABPC1
  Gene Name: poly(A) binding protein, cytoplasmic 1
  ENST ID: ENST00000523636
  CDS Start-End: 1-496
ccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaaattgatcagggaccatgaaaagaaacttgtgcttcaccgaagaaaaatatctaaacatcgaaaaacttaaatattatggaaaaaaaacattgcaaaatata

SEQ ID NO: 167059 - DNA, 453 bp, Homo sapiens
  Payload ID: 12882
  Gene Symbol: PABPC1
  Gene Name: poly(A) binding protein, cytoplasmic 1
  ENST ID: ENST00000519363
  CDS Start-End: 339-453
cccttctccccggcggttagtgctgagagtgcggaccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctct

SEQ ID NO: 167060 - DNA, 628 bp, Homo sapiens
  Payload ID: 12882
  Gene Symbol: PABPC1
  Gene Name: poly(A) binding protein, cytoplasmic 1
  ENST ID: ENST00000521865
  CDS Start-End: 242-628
gcggccgacgcgcgtggcggcggtgccggctgggactcgtagtgcggtccggccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaag

SEQ ID NO: 167061 - DNA, 2331 bp, Homo sapiens
  Payload ID: 12882
  Gene Symbol: PABPC1
  Gene Name: poly(A) binding protein, cytoplasmic 1
  ENST ID: ENST00000522387
  CDS Start-End: 317-2131
aaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccattccaaaatatgcccggtgctatccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaaattgatcagggaccatgaaaagaaacttgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgattt

SEQ ID NO: 167062 - DNA, 2401 bp, Homo sapiens
  Payload ID: 12882
  Gene Symbol: PABPC1
  Gene Name: poly(A) binding protein, cytoplasmic 1
  ENST ID: ENST00000519004
  CDS Start-End: 364-2139
cccttctccccggcggttagtgctgagagtgcggagtgtgtgctccgggctcggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgaggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccattccaaaatatgcccggtgctatccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaaattgatcagggaccatgaaaagaaacttgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaacaaaaaaacacaaaaaaatagtaaaatataaaaacaaattaatgttttatagaccct

SEQ ID NO: 167063 - DNA, 593 bp, Homo sapiens
  Payload ID: 12882
  Gene Symbol: PABPC1
  Gene Name: poly(A) binding protein, cytoplasmic 1
  ENST ID: ENST00000522720
  CDS Start-End: 369-593
aggcaccgcttctgcggccgacgcgcgtggcggcggtgccggctgggactcgtagtgcggtccggccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgat

SEQ ID NO: 167064 - DNA, 522 bp, Homo sapiens
  Payload ID: 12882
  Gene Symbol: PABPC1
  Gene Name: poly(A) binding protein, cytoplasmic 1
  ENST ID: ENST00000523555
  CDS Start-End: 1-522
cagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtgg

SEQ ID NO: 167065 - DNA, 754 bp, Homo sapiens
  Payload ID: 12882
  Gene Symbol: PABPC1
  Gene Name: poly(A) binding protein, cytoplasmic 1
  ENST ID: ENST00000520142
  CDS Start-End: 401-754
gcttccccttctccccggcggttagtgctgagagtgcggagtgtgtgctccgggctcggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgataca

SEQ ID NO: 167066 - DNA, 631 bp, Homo sapiens
  Payload ID: 12882
  Gene Symbol: PABPC1
  Gene Name: poly(A) binding protein, cytoplasmic 1
  ENST ID: ENST00000518196
  CDS Start-End: 308-631
cggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaaga

SEQ ID NO: 167067 - DNA, 608 bp, Homo sapiens
  Payload ID: 12882
  Gene Symbol: PABPC1
  Gene Name: poly(A) binding protein, cytoplasmic 1
  ENST ID: ENST00000518293
  CDS Start-End: 1-128
atatgctcgagtctccagagtcactccgttctaaggttgatgaagctgtagctgtactacaagcccaccaagctaaagaggctgcccagaaagcagttaacagtgccaccggtgttccaactgtttaaaaaacaaggacattctcctccataaccatgacaccgccatgaaaacgatcagcaccgtcgaatcctcacgccccactcaagttccttgattgcttcaataatgtcctccgtagcaaaaggatctagttcaaaatcgggagttacatttcattgtcatgcctaaaacgtaagaattgctcattcactttggagcagttcttcagtctatccttgattttcatgaccttgacacttttgaacattatagaccagttattcaatagaatatctttcaatctgggtttgtccgatacctctttattattagattgaaatgatacattttggtggaactatcacagaattgacattgcattcttctcattacatcctgtctggtggcctgtgattctgttttatctcattaccaatggcgtttgttttgagcatttgattaagttgttatctgccactataaagttgctatttttctctttataa

SEQ ID NO: 167068 - DNA, 1569 bp, Homo sapiens
  Payload ID: 12882
  Gene Symbol: PABPC1
  Gene Name: poly(A) binding protein, cytoplasmic 1
  ENST ID: ENST00000610907
  CDS Start-End: 1-1569
atgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaa

SEQ ID NO: 167069 - DNA, 1851 bp, Homo sapiens
  Payload ID: 12883
  Gene Symbol: PABPC1L
  Gene Name: poly(A) binding protein, cytoplasmic 1-like
  Uniprot ID: Q4VXU2
  ENST ID: ENST00000217073
  CDS Start-End: 1-1845
atgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacgcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtggcgtgtgacgagcatggctcccggggtttcggctttgtccattttgagacccatgaggccgcacagcaggccatcaacaccatgaatgggatgctgctgaatgaccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaaggtgatgacagagggtggccacagcaaggggtttggctttgtgtgtttttcctccccagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccagcctccagcccaggctgcatactatggctgtggcccagtgacacccacccagcctgcccccaggtggacatcccagccacctagaccttcctgtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactgaaaccag

SEQ ID NO: 167070 - DNA, 1263 bp, Homo sapiens
  Payload ID: 12883
  Gene Symbol: PABPC1L
  Gene Name: poly(A) binding protein, cytoplasmic 1-like
  Uniprot ID: Q4VXU2
  ENST ID: ENST00000217074
  CDS Start-End: 83-1075
ggagggcttccgcccgggtgagcgcggggctgctgggtgacccggctcctgcttgccccgcagccccggccccctgcccaccatgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacgcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtggcgtgtgacgagcatggctcccggggtttcggctttgtccattttgagacccatgaggccgcacagcaggccatcaacaccatgaatgggatgctgctgaatgaccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccag

SEQ ID NO: 167071 - DNA, 670 bp, Homo sapiens
  Payload ID: 12883
  Gene Symbol: PABPC1L
  Gene Name: poly(A) binding protein, cytoplasmic 1-like
  ENST ID: ENST00000217075
  CDS Start-End: 41-556
gtgactctgaaaattcttgcaaagctgagaaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgc

SEQ ID NO: 167072 - DNA, 2129 bp, Homo sapiens
  Payload ID: 12883
  Gene Symbol: PABPC1L
  Gene Name: poly(A) binding protein, cytoplasmic 1-like
  Uniprot ID: Q4VXU2
  ENST ID: ENST00000255136
  CDS Start-End: 83-1927
ggagggcttccgcccgggtgagcgcggggctgctgggtgacccggctcctgcttgccccgcagccccggccccctgcccaccatgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacgcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtggcgtgtgacgagcatggctcccggggtttcggctttgtccattttgagacccatgaggccgcacagcaggccatcaacaccatgaatgggatgctgctgaatgaccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaaggtgatgacagagggtggccacagcaaggggtttggctttgtgtgtttttcctccccagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccagcctccagcccaggctgcatactatggctgtggcccagtgacacccacccagcctgcccccaggtggacatcccagccacctagaccttcctgtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactgaaaccagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgccttg

SEQ ID NO: 167073 - DNA, 2100 bp, Homo sapiens
  Payload ID: 12883
  Gene Symbol: PABPC1L
  Gene Name: poly(A) binding protein, cytoplasmic 1-like
  ENST ID: ENST00000372819
  CDS Start-End: 902-1351
cctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatttcagcttaaaatgccacccagagaccaagttcattctgtcaactgatctccagcacctggcccagagacggaaagtacaaagactagtaaaatacatccttgcccttaaggagctaagtacccaaaacctgtaatccatcttgagtcaccagagtacggttgctcagaaacagcagtggtgcggtggaaagggcatcaaccctgcgatccggacaagtcactccatccctctgatcatgcgtgcccacctaccacatgaggatatcacttcatagacttgctggaagggttcattgtgttagcctgttccctgagctctcttcgtgatcaagaagactgatcagataaatcaagagacttgcccaaaattacctaggaaatctgtagcagcagcagaaccaaactccggtccttgctaaatctagataccaggctagcttttctatggacccagaattaacccatacaaatgtacaagcttttccagaccagctggggtgagatgaatgaaaatggcagcaacatcaatacctcagcttcttcagcaacttcatcaagtaaggctgccatgaggaagtgggcctaaaggagagttttctagaacaaagaagggggcaaaggagtggcttgaaactgcaaaaagtgcagacaaaaaaaaaaaaaaaaagaatgaaatctggagaggatgtgaggagaggtctagcaaaatgattaaaaatttggacttagcatcaaagtcaaacagatccatattcaaa

SEQ ID NO: 167074 - DNA, 536 bp, Homo sapiens
  Payload ID: 12883
  Gene Symbol: PABPC1L
  Gene Name: poly(A) binding protein, cytoplasmic 1-like
  ENST ID: ENST00000372822
  CDS Start-End: 1-405
tgcaaatgttcctcagcagcacatagcacctatcgggtccaggagccggctgtgcacatcccaggacaggagcccctgaccgcgtccatgctggctgcggcgcccctgcatgagcaaaagcagatgattggcacctgttatcttgtcttaaaacgctggtcagactggatggtcctgagctttcttccactgctgctgtcctgtgactttgaggggagcgtctctacccccttatccatgatgtccacacccagctggctggcaagatcacgggcatgctgctggagattgacaactcagagctgttgctcatgctggagtctccagaatccctccatgccaagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgc

SEQ ID NO: 167075 - DNA, 2223 bp, Homo sapiens
  Payload ID: 12883
  Gene Symbol: PABPC1L
  Gene Name: poly(A) binding protein, cytoplasmic 1-like
  ENST ID: ENST00000372824
  CDS Start-End: 1519-2025
ttggctcgctgcaaactcttcctcctgggttcaagtgattcttgtgcctcagcctcccgggtagctgggattacaggtgcgtgccaccacactcagctaattttttgtatttttagtagagacggggtttcaccatgttggccaggctggtcttgaactcctgacctcaagtgatgtgccctccttgacctcctaaagtgctgggattacaggcatgagccaccatgatcggccctaaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactgaaaccagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgc

SEQ ID NO: 167076 - DNA, 854 bp, Homo sapiens
  Payload ID: 12883
  Gene Symbol: PABPC1L
  Gene Name: poly(A) binding protein, cytoplasmic 1-like
  ENST ID: ENST00000372826
  CDS Start-End: 1-458
ggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaaggcccagagacggaaagtacaaagactagtaaaatacatccttgcccttaaggagctaagtacccaaaacctgtaatccatcttgagtcaccagagtacggttgctcagaaacagcagtggtgcggtggaaagggcatcaaccctgcgatccggacaagtcactccatccctctgatcatgcgtgcccacctaccacatgaggatatcacttcatagacttgctggaagggttcattgtgttagcctgttccctgagctctcttcgtgatcaagaagactgatcagataaatcaagagacttgcccaaaattacctaggaaatctgtagcagcagcagaaccaaactccggtccttgctaaatctagataccaggctagcttttctatggacccagaattaacccatacaaatgtacaagcttttccagaccagctggggtgagatgaatgaaaatggcagcaacatcaata

SEQ ID NO: 167077 - DNA, 1178 bp, Homo sapiens
  Payload ID: 12883
  Gene Symbol: PABPC1L
  Gene Name: poly(A) binding protein, cytoplasmic 1-like
  ENST ID: ENST00000479873
  CDS Start-End: 391-915
gaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggcacctgttatcttgtcttaaaacgctggtcagactggatggtcctgagctttcttccactgctgctgtcctgtgactttgaggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactgaaaccagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgc

SEQ ID NO: 167078 - DNA, 1910 bp, Homo sapiens
  Payload ID: 12883
  Gene Symbol: PABPC1L
  Gene Name: poly(A) binding protein, cytoplasmic 1-like
  Uniprot ID: Q4VXU2
  ENST ID: ENST00000537323
  CDS Start-End: 21-1013
gccccggccccctgcccaccatgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacgcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtggcgtgtgacgagcatggctcccggggtttcggctttgtccattttgagacccatgaggccgcacagcaggccatcaacaccatgaatgggatgctgctgaatgaccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactgaaaccagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaat

SEQ ID NO: 167079 - DNA, 2237 bp, Homo sapiens
  Payload ID: 12884
  Gene Symbol: PABPC1L2A
  Gene Name: poly(A) binding protein, cytoplasmic 1-like 2A
  Uniprot ID: Q5JQF8
  ENST ID: ENST00000373519
  CDS Start-End: 127-729
gcggatgcggatgcggatgcgaaggtggcggccgaggtggcggccgaggtggcggctgcggcggccgccgcggatgcagatgcggatgagaccctcggtgactgtgaggggaacccagattttcagatggcctccctgtacgtgggcgacctgcaccctgaggtgaccgaggcaatgctgtacgagaagttcagtccagctgggcccatcctctccatccgcatctgcagggacaagatcacccgccgctcattgggctacgcgtatgtcaactaccagcaaccggtggacgccaagcgggccctggagaccctgaactttgatgtcataaagggcaggccagtgcgcatcatgtggtcccagagggacccgtcgctccgcaagagcggggtgggcaacgtcttcatcaagaacctgggcaagaccatcgacaacaaggcgctgtacaacatcttctcggcgttcggcaacatcctctcctgcaaagtggcctgtgacgaaaaggggcccaagggctacgggttcgtgcacttccaaaagcaggaatctgcggagcgggccatcgatgtgatgaatggcatgttcctgaactaccgcaaaattttcgtcgggagattcaagtcgcataaagaacgagaggccgaaaggggagcctgggccaggcagtccactagtgctgacgtcaaggatttcgaggaagacaccgacgaggaggccaccttgcgatgaagacatcccaggagctagccagccagcagagccaaaccttggctcacacccggtttacaaccccccacccccagccctcccccgccaacccaccagcagtgtatttattgtattgagagtgcaggtctctctctctctctctctccccttctctctccccgcttcctattttctccctccacctctcctctccttcccttcctctcccccgcccacccccaccaagggcgttgtgaataatcttactaatctgtgccatttgtaggttaaaggctgcctcttctccctgtggtttgatttaaaaagcattttcattctctctttgtttactgcacaggtggtacaatttcatggtagaatcatcagaaaggagaaggatatcagatgagggaagaaacaagagagtaattgctcccctggtcctactccccagagagaaccacttttacctttttggtgtgctgcttttccaggctctcttctctccctctctctcctttgctcacccccaccccgccttcccttttaacacaccgttatagaatggttcatgtatgtggtgtttcttaacctgctttttcagcaactaaaaccaaacaaaaatcaacccattgaacttctttccatgttatcaacaggcttatgaaacgtcatcttcagtgcctgcagagtgctccagtgtatccgtggaccttaacatttctgtaatcattcccgcattgttggacattcaggtggtgcctagttctttccctgtgtttaagaccaacattgcgtgctctgtgctttgatgagtgaatccttccttgtcaagccaaatctttgctagcatcccggtggtctccttaactgcggacttgcaagatccacatatagacattttaaagacttttcctgtgtgttgccaaaaggcccccttcataagcattgtaccgatttgcactcgtgccggccagcgcagctagtaaagagtatgcccgtttcccctgcatagtctcctggtcactgtaattgatcgtgtgtgtgcgtgcgtgtgtgtgtgtgtgtgtgtgtgtgtgtgtcttggccagcttggcgggctacaaagggtgtttcgctgtcctcggtagttttgctggaaacaaacactgcttatgaccccattcccctgtgccctcttcctgtccttttccctgttgtcagaaaagtaattcagcgtcattgcaagaaaaaaaaatcacaaagcagacaagttaccagaagaaaattaaagtcaccagtaatcatttctgatgattacacacacattccagaaacattttcatgcacacctctctgatattttctagaactacctgaaacatttttgtctgtaggtctagtttttttcttatgcatatatcatatatgtatattatgatgtacagactgtttttatatctgcttttcacacatacatgtgtgtgtatatttatacacacacatattcttgaacttcatttcatgtcattaaagatacttttaaaata

SEQ ID NO: 167080 - DNA, 2197 bp, Homo sapiens
  Payload ID: 12885
  Gene Symbol: PABPC1L2B
  Gene Name: poly(A) binding protein, cytoplasmic 1-like 2B
  Uniprot ID: Q5JQF8
  ENST ID: ENST00000373521
  CDS Start-End: 127-729
gcggatgcggatgcgaatgcgaaggtggcggccgaggtggcggccgaggtggcggctgcggcggccgccgcggatgcagatgcggatgagaccctcggtgactgtgaggggaacccagattttcagatggcctccctgtacgtgggcgacctgcaccctgaggtgaccgaggcaatgctgtacgagaagttcagtccagctgggcccatcctctccatccgcatctgcagggacaagatcacccgccgctcattgggctacgcgtatgtcaactaccagcaaccggtggacgccaagcgggccctggagaccctgaactttgatgtcataaagggcaggccagtgcgcatcatgtggtcccagagggacccgtcgctccgcaagagcggggtgggcaacgtcttcatcaagaacctgggcaagaccatcgacaacaaggcgctgtacaacatcttctcggcgttcggcaacatcctctcctgcaaagtggcctgtgacgaaaaggggcccaagggctacgggttcgtgcacttccaaaagcaggaatctgcggagcgggccatcgatgtgatgaatggcatgttcctgaactaccgcaaaattttcgtcgggagattcaagtcgcataaagaacgagaggccgaaaggggagcctgggccaggcagtccactagtgctgacgtcaaggatttcgaggaagacaccgacgaggaggccaccttgcgatgaagacatcccaggagctagccagccagcagagccaaaccttggctcacacccggtttacaaccccccacccccagccctcccccgccaacccaccagcagtgtatttattgtattgagagtgcaggtctctctctctctctctctccccttctctctccccgcttcctattttctccctccacctctcctctccttcccttcctctcccccgcccacccccaccaagggcgttgtgaataatcttactaatctgtgccatttgtaggttaaaggctgcctcttctccctgtggtttggtttaaaaagcattttcattctctctttgtttactgcacaggtggtacaatttcatggtagaatcatcagaaaggagaaggatatcagatgagggaagaaacaagagagtaattgctcccctggtcctactccccagagagaaccacttttacctttttggtgtgctgcttttccaggctctcttctctccctctctctcctttgctcacccccaccccgccttcccttttaacacaccgttatagaatggttcatgtatgtggtgtttcttaacctgctttttcagcaactaaaaccaaacaaaaatcaacccattgaacttctttccatgttatcaacaggcttatgaaatgtcatcttcagtgcctgcagagtgctccagtgtatccgtggaccttaacatttctgtaatcattcccgcattgttggacattcaggtggtgcctagttctttccctgtgtttaagaccaacattgcgtgctctgtgctttgatgagtgaatccttccttgtcaagccaaatctttgctagcatcccggtggtctccttaactgcggacttgcaagatccacatatagacattttaaagacttttcctgtgtgttgccaaaaggcccccttcataagcattgtaccgatttgcactcgtgccggccagcgcagctagtaaagagtatgcccgtttcccctgcatagcctcctggtcactgtaattgatcgtgtgtgtgcgtgcgtgcgtgtgtgcatgcgtgtgtgtgtctttgtgtgtgtgtcttggccagcttggcgggctgcaaagggtgtttccctgtcctcagtggttttgctgcaatcaaacactgtttattacccccttcccctgtgcccacttcctgtccttttccctgttgtcagaaaaataattcagcgtcattgcaggaaaaaaataatcacgaagcagacaagttaacagaagaaaattaatgtcaccagtaatcatttctgatgattacttatacattcctgaaacattttcatctgtatctgccctgtatttttcatgtgatatatatgtgaaattattgtatatactgtttcaatatctgctttttcacacagaaatatatattatagacatagatttatagatattcttgaactttcatgtcattaaatattcttctaaaatag

SEQ ID NO: 167081 - DNA, 3387 bp, Homo sapiens
  Payload ID: 12886
  Gene Symbol: PABPC3
  Gene Name: poly(A) binding protein, cytoplasmic 3
  Uniprot ID: Q9H361
  ENST ID: ENST00000281589
  CDS Start-End: 332-2227
ctcttttacaaaataacccggtgaagcagctgagcccgagccgcccgccagcggccccgcagcagctccaagaaggaactaagagaccaaggccttcctgctgcccggacccgacaccgctaccctggctccccgccggcagccggcagccagcggcagcggatcgaccccgttctgcggccgttgagtagttttcgatttcggctgatttttgtccctctgcgcttgcccccgctcccctccctccggctacgcccccggccccggcacgcgctctactcctgtaacggaaaggtcgcggcttgtgtgcctgcgggcagccgtgccgagaatgaaccccagcacccccagctacccaacggcctcgctctacgtgggggacctccaccccgacgtgactgaggcgatgctctacgagaagttcagcccggcagggcccatcctctccatccggatctgcagggacttgatcaccagcggctcctccaactacgcgtatgtgaacttccagcatacgaaggacgcggagcatgctctggacaccatgaattttgatgttataaagggcaagccagtacgcatcatgtggtctcagcgtgatccatcacttcgaaaaagtggagtgggcaacatattcgttaaaaatctggataagtccattaataataaagcactgtatgatacagtttctgcttttggtaacatcctttcgtgtaacgtggtttgtgatgaaaatggttccaagggttatggatttgtacactttgagacacacgaagcagctgaaagagctattaaaaaaatgaacggaatgctcctaaatggtcgcaaagtatttgttggacaatttaagtctcgtaaagaacgagaagctgaacttggagctagggcaaaagagttccccaatgtttacatcaagaattttggagaagacatggatgatgagcgccttaaggatctctttggcaagttcgggcccgccttaagtgtgaaagtaatgaccgatgaaagtggaaaatccaaaggatttggatttgtaagctttgaaaggcatgaagatgcacagaaagctgtagatgagatgaatggaaaggagctcaatggaaaacaaatttacgttggtcgagctcagaaaaaagtggaacggcagacggaacttaagcgcacatttgaacagatgaagcaagataggatcaccagataccaggttgttaatctttatgtgaaaaatcttgatgatggtattgatgatgaacgtctccggaaagcgttttctccatttggtacaatcactagtgcaaaggttatgatggaaggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggcttacctcactaacgagtatatgcagagaatggcaagtgtacgagctgtgcccaaccagcgagcacctccttcaggttacttcatgacagctgtcccacagactcagaaccatgctgcatactatcctcctagccaaattgctcgactaagaccaagtcctcgctggactgctcagggtgccagacctcatccattccaaaataagcccagtgctatccgcccaggtgctcctagagtaccatttagtactatgagaccagcttcttcacaggttccacgagtcatgtcaacgcagcgtgttgctaacacatcaacacagacagtgggtccacgtcctgcagctgctgctgctgctgcagctacccctgctgtgcgcacggttccacggtataaatatgctgcgggagttcgcaatcctcagcaacatcgtaatgcacagccacaagttacaatgcaacagcttgctgttcatgtacaaggtcaggaaactttgactgcctccaggttggcatctgcccctcctcaaaagcaaaagcaaatgttaggtgaacggctctttcctcttattcaagccatgcaccctactcttgctgggaaaatcactggcatgttgttggagattgataattcagaacttctttatatgctcgagtctccagagtcactccgttctaaggttgatgaagctgtagctgtactacaagcccaccaagctaaagaggctacccagaaagcagttaacagtgctaccggtgttccaactgtttaaaattgatcagagaccacgaaaagaaatttgtgcttcaccgaagaaaaatatctaaacatcgagaaactatgggaaaaaaaattgcaaaatctaaaataaaaaatgcaaaatctaaaataaaaaatggaaaggaaactttgaaccttatgtaccgagcaaatgcaaggtctagcaaatataatgctagtcctagattacttattgatttaaaaacaaaaaaaagattacttaattttgatttaaaaacaaaaaatcgtaaaatacaaaaaccagttaatgttttgtagaccctgggaaaagaattttcagcaaagtacaaaaatttaaagcattcctttaattttttaattctttactgtggaatagctcaaaatgtccattctgttttaagtaacagaattgataactgagcaaggaaacatggtttggattataaaattcttgctttaataaaaatttcttaaacagtgaaaaaaagaaaaatcatcaattttactaatagtctttctttacattttctattattctatctcccactatatttcaaatatgaaaatcactttttcaccaaaattttaggtctttacataatagtgtttatttttaatattcataaatgaaaatatgcaatgacaaaatagtaattataaattcagtaacatttgttcaaaattgtaagacaattattaatttatactgcattatttttaaataaaaaataaatacatagttttaaaaatctaattgaacaggaggctaaacatggttctgatcacagagataatcacttttaatcatttggttttagtgtttctggtagttgattttcttcaataataattgtacatagttatttcttggtttatcaattttgtaatttaactattgacttcctgctgtaacaaataaggatatgtttcatctacctcttcccaccatccctcctcctcctcccaatataatttatcactacttgtagctcctttattggtaatattaattaatataaatatttataattaatgttacacctagtgaattgtataaaaggacagcccatttgagcattctcctttaagatgagtagaggctgtgacattgcactacatagaaatataattataccatattactttgcaataaactatgtattatagaga

SEQ ID NO: 167082 - DNA, 3016 bp, Homo sapiens
  Payload ID: 12887
  Gene Symbol: PABPC4
  Gene Name: poly(A) binding protein, cytoplasmic 4 (inducible form)
  Uniprot ID: Q13310
  ENST ID: ENST00000372856
  CDS Start-End: 801-2696
gggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 167083 - DNA, 3048 bp, Homo sapiens
  Payload ID: 12887
  Gene Symbol: PABPC4
  Gene Name: poly(A) binding protein, cytoplasmic 4 (inducible form)
  Uniprot ID: Q13310
  ENST ID: ENST00000372857
  CDS Start-End: 794-2728
gcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 167084 - DNA, 2753 bp, Homo sapiens
  Payload ID: 12887
  Gene Symbol: PABPC4
  Gene Name: poly(A) binding protein, cytoplasmic 4 (inducible form)
  Uniprot ID: Q13310
  ENST ID: ENST00000372858
  CDS Start-End: 451-2433
ctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 167085 - DNA, 2470 bp, Homo sapiens
  Payload ID: 12887
  Gene Symbol: PABPC4
  Gene Name: poly(A) binding protein, cytoplasmic 4 (inducible form)
  ENST ID: ENST00000372862
  CDS Start-End: 303-2150
tttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 167086 - DNA, 1663 bp, Homo sapiens
  Payload ID: 12887
  Gene Symbol: PABPC4
  Gene Name: poly(A) binding protein, cytoplasmic 4 (inducible form)
  ENST ID: ENST00000421687
  CDS Start-End: 1-1652
gaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaa

SEQ ID NO: 167087 - DNA, 898 bp, Homo sapiens
  Payload ID: 12887
  Gene Symbol: PABPC4
  Gene Name: poly(A) binding protein, cytoplasmic 4 (inducible form)
  ENST ID: ENST00000451091
  CDS Start-End: 512-898
ctctctccgccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccggggcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaag

SEQ ID NO: 167088 - DNA, 876 bp, Homo sapiens
  Payload ID: 12887
  Gene Symbol: PABPC4
  Gene Name: poly(A) binding protein, cytoplasmic 4 (inducible form)
  ENST ID: ENST00000437136
  CDS Start-End: 1-587
ttcgccatctggctccaactggtaatgctccggcctctcgtggcctccctactaccactcagagagtcgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 167089 - DNA, 591 bp, Homo sapiens
  Payload ID: 12887
  Gene Symbol: PABPC4
  Gene Name: poly(A) binding protein, cytoplasmic 4 (inducible form)
  ENST ID: ENST00000474378
  CDS Start-End: 1-591
cttttggaaacatactgtcctgcaagagacagggtctccattgtccaacgatctggctccaacgatcctcctgctttggcctcccaaagcattgggattacaggcatgagccacagcacccaattgtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaac

SEQ ID NO: 167090 - DNA, 1212 bp, Homo sapiens
  Payload ID: 12887
  Gene Symbol: PABPC4
  Gene Name: poly(A) binding protein, cytoplasmic 4 (inducible form)
  ENST ID: ENST00000470443
  CDS Start-End: 1-337
caacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtgtgagtgtcccagtccggagcaacaaccatcgcatgagccagccgtggccccacctcgctattaactggcacacacaaggcggctactggttctcggcccaagtgtggcctgctcctacctctccactccagggctgatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacag

SEQ ID NO: 167091 - DNA, 352 bp, Homo sapiens
  Payload ID: 12887
  Gene Symbol: PABPC4
  Gene Name: poly(A) binding protein, cytoplasmic 4 (inducible form)
  ENST ID: ENST00000530186
  CDS Start-End: 1-206
cactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgtatgtgtggctattttcatttttgttcctatgagcattgttcctatgagcattgtctttgtggtttgacctgaggttgtatatatgctcactgcttagctctgggaatacaataagtacagttagttacacg

SEQ ID NO: 167092 - DNA, 746 bp, Homo sapiens
  Payload ID: 12887
  Gene Symbol: PABPC4
  Gene Name: poly(A) binding protein, cytoplasmic 4 (inducible form)
  ENST ID: ENST00000527718
  CDS Start-End: 1-746
cagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggcttccaaggaatgccaagtgctatacgccagtctgggcctcgtccaactcttcgccatctggctccaactggtaatgctccggcctctcgtggcctccctactaccactcagagagtcggcgttcccacagctgtgcagaacttagcgccacgcgctgctgttgctgctgctgctccccgggctgttgccccctacaaatacgcctccagtgtccgcagccctcatcctgccatacagcctctgcag

SEQ ID NO: 167093 - DNA, 532 bp, Homo sapiens
  Payload ID: 12887
  Gene Symbol: PABPC4
  Gene Name: poly(A) binding protein, cytoplasmic 4 (inducible form)
  ENST ID: ENST00000531243
  CDS Start-End: 519-532
tctccgccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccggggaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggc

SEQ ID NO: 167094 - DNA, 4944 bp, Homo sapiens
  Payload ID: 12888
  Gene Symbol: PABPC4L
  Gene Name: poly(A) binding protein, cytoplasmic 4-like
  Uniprot ID: P0CB38
  ENST ID: ENST00000421491
  CDS Start-End: 258-1370
gggcttcccgcccgcccgcagacgaccgccgttctgttgccgcgtcctaggagggccagattggtggctgtggggacttttggatgagggtgttgcctgagctgggggagtcgtgtctgaactccattgcttggcctttgtgtggtgatcccgaggcctccacacttgaaccgggccaaagctgtgacctagtatccccccacagggattgctcaaagaactccaggggacaaactcacagtggcaaggacaaggagatgaatgtagcagccaagtaccgcatggcctccctgtatgtgggtgacttacatgcagatgtcaccgaggacctgctgttcaggaagttcagcactgtggggcctgtgctgtccatccgcatttgcagggaccaggtcacccgccgctctctgggctatgcctacgtgaacttcttgcagctggctgatgcccagaaggcgctggacacaatgaactttgacatcataaaaggcaaatccatccgtctcatgtggtctcagcgcgatgcctacttgaggagatctggaattgggaacgtattcatcaagaatctggacaaatctatcgataacaaaaccctttatgaacatttttcagcttttggaaagatcctttcctccaaggtgatgagtgatgatcaaggctccaagggctatgcatttgtgcactttcagaaccagagtgctgcagacagggccattgaggagatgaatggaaaactactcaagggctgcaaggtgtttgttggcagattcaaaaaccgaaaagatcgtgaagctgaactcagaagcaaagccagtgaattcaccaatgtttacataaaaaactttggaggtgacatggatgatgagagattgaaggacgttttcagcaaatatggcaaaactctgagtgttaaggtgatgacagattccagtgggaaatccaaaggctttggctttgtgagttttgatagccatgaggctgccaagaaagctgttgaagaaatgaatggaagggacataaatgggcagctgatttttgtaggccgggctcaaaagaaagtcgagcgacaggctgagttaaagcaaatgtttgagcagctgaaaagggaacgaattcgtgggtgccagggggtaaaactctatattaagaaccttgatgacaccatcgatgatgaaaaactacgaaacgaattttcttcatttggatcaattagcagagttaaggtaatgcaggaagaggggcagagcaaagggtttggcttgatctgcttctcctctcctgaggatgctactaaagcaatgactgagatgaatggccgcatcttgggctccaaacctcttagcattgccttggcccagagacactaggaaagaaaaacgtacctttccagctagtatctgcagcaggtgggagaatgatagtgatctctgcctgaattgacctcagtaaatttcatattccacatgatgggtgcttagtttagtaaactttatgataaaacgttttttatacaaagccattttttttcttttgtggaaaaatagatggagcttagttcattttacagaggcacattttctaattttaatattgcacatttttcttattttgatatgttcatagcaataagtataaatagatatatttttacatttgaaccaaatgaaatgaggtaattatttgaatttattgcatatttattattttagtaatattgctagctttaatttcttctatgaaaatatgctcaaaatagttcttacaactaaagattccaaagtatttttaccaacagaaattttctaatttttcatccaagttttgagaaatcaaacttttagaaatttatagtacgaatttaaagacctaatttcattttgaattaatgcttaaaatagtcagatatagttgaatttcttttaaatttatatcctgacatgcttgtttttcggatggtttaaattaagatgatggaagtttttaatgttgcctaaaaactggctttatgtgttttgttctttccattagttgactataattcaggtacttactagttaatctaaattgtaacttgcactgtaaaaccttaacttctacattccttaagttataaatctgttatcaactcaggtgatccaaagttggcctggtcttaaatctcttcatacctatatggcttaatatattatcttaaatttttaccagatgctaatattatgaaaatcatacatacagattatagaaattctgtttaaaaacttttaaaatctcttttatattgttttgtgtagtgattttctcttagggttcagaaaagtaagttcctctatttttatgtactcacatctccttttattagaatgtggcagctatggaacccattaaggttcacttttagccttcattgatcagaaacactgattgattttctgatgaattgaagttacatcacttattctgttttctagcataatttttagtttagaaccattcccctattttccttgctctcctgcctttcatctatattcctcagctttttaaaatactttctaaaggatttttttatgttggcttttaatatgtgctgcttcaaatccatttggaaatcgaggcaagagttatttaattacatttaaataattgctttacaaattctgattcataccaaaggtatctagcaagcaagtgcttttgtttttactgttttcatatttttacttggcttagttttttctcataactattattcacattctctatttcatatattactaatataaaagaaatagtaaaatattttttggcaatacctcagcttatgaatgagaaaaatttgttgccttttatttttatagaaattatatgtatattctttgcacattttctaaaatgaaaatcttttagtccataaaaaattatggacaatgaaaaaattaaaagaatttgcatataattgtattatgcaaaccaattccctattataatttgttacatatttttctatttttttctctctctacatatatacacctaggtaatttaagaaaaataggataatattacaaatgttgtttgaaattgctttcttaaacaatatgctatggtcaacttttatgctcacaataattatttgtcttataatctgagtgacttttatgttttgttcaatgactgtaccaaaatataactaatttcttattgataaacttcttgttgctagataatttcttccttttttcttcttcctctgtcataaataacttggagattaacatccttgcgaacttatatatgcaaatatatctattttcttaagaaaatgtttagaagtagaattaatggttaaaaaagaatcaattttaaaaagtaattttgataaatattgcttaaatgctgtccagaatacttgtggcacttacatttccattgtcattgtaggagaatgcctatttccatatgctccaagaaacaagggttttttttaagctgttggtcaattcaacatgatatgtaaaacaaaccatttcatcattgctttatttcacttttgtaaattacaaaagttaaacagtatttgtgtactcactgaccatttgtattttcatacttataagttaatgtctcatgatcataatttattttcctgttggggtgttttttatttacatggatttttagatttctttgcatattatgactacattttagacttttccccctgatatttcactgtctttatagttttgaaggttattccaaaattgaatgttaagctggaaagttttagtattctactgaaatggctttgatgtcatgcttcaaaatattttgaacactttaaatacatatattcacacaaatatatatacacccacacaatttatctgtattgtgtttatgactttcagattttcatattctcaatgcttctaactaaaattttggttcataaaaagtatcttatataaaacctatagtaaatattttaaaaatgtgcttttccatttttaataacatgtattttggtaaatacttgattcagagagccaatgaattagagttggcatatgagtttcacatagattcttatactaggtaagtatttaccaaaacatgtatcagaagcagaaagttgttaaaaaggtttaccagacaacaagactggaaagtgtattaagtgtgcctggccttgacatcttgttctggataatctagtctacatcttaatttaggaaagctaatctgtaaaactgttcaaatatttgaacaatatttgataatgcttacataatctttcaagataatatcaggaaacagagttctttcatgtatgtaagtagttaataggacataacatcagatgtctagatgaattatagctatggcttaattacacaataatctgccttcttagtagaaattgcttatttccagcatttgctgtaaaaaaaaaaaagacagtcagtttacaaaaatatacaatcctatggatttaatttatttaaattttgttcattctaattttttttggtgcgtgataatagcaagttatcttagttgaaaatagagattcattcattaaagaatattaaatcttttgtgcccaagtgccttaataaataagtagaatcttaacttttctgataagcattccagtaaaagctaatgtacatagatatgccttgagccactgtttctactttcacccttctctccacacatattgccacgtctgctgtgtagttacctgcttacatgtacagccatttcaataaatgtattcttttaacattttatcttttaaatttcaaataggaatttatagttggtaaaaataaaaattttaaagtgatttaatattgtcattttcatgttctcaatattgttatagatccactgagaaaatgtcaaataaaatctaatatttcaaaggtgaaa

SEQ ID NO: 167095 - DNA, 3221 bp, Homo sapiens
  Payload ID: 12889
  Gene Symbol: PABPC5
  Gene Name: poly(A) binding protein, cytoplasmic 5
  Uniprot ID: Q96DU9
  ENST ID: ENST00000312600
  CDS Start-End: 215-1363
gcgcgtttgccagtcagtctctccggacctgcctcgagcctcaggctgctgaaatcaccgcgcctcactcgcctcgacagtgattctgagtctgcttttagcttccttttgcctgccttggctttttctgttcgtgaacagctgtttggcccatagcttagagaaagcagccttttttctcttcaaagagaacctcctcccagtgctcagagagatggggagcggggagcctaatcctgctggcaagaaaaagaagtatctcaaggccgctctgtacgtgggtgacttggacccagatgtcaccgaggacatgctctataagaagttcaggcctgctggccctctgcgattcacccgaatctgccgtgatccggtgacccgcagccccctgggctatgggtatgttaacttccgctttcccgcggatgcagagtgggccttgaacaccatgaattttgatttgattaatggaaaaccattccgccttatgtggtctcagccagatgaccgcttaagaaagtctggagtgggaaatatattcatcaaaaacctggacaaatccatagacaatagggccctgttttacttattttctgcttttgggaacattctgtcctgcaaagtcgtatgcgatgacaacggctctaagggttatgcctatgttcactttgacagcctggccgctgccaatagagccatctggcacatgaatggagtgcggctcaacaaccgccaggtgtatgttggcagattcaaattcccagaagagcgggcggctgaggtcagaaccagggatagagcaactttcaccaatgttttcgttaaaaacattggagacgacatagatgacgaaaaactgaaggaacttttctgtgaatatgggccaactgagagtgttaaagtaataagagatgccagtgggaaatctaaaggctttggatttgtgagatatgagacacacgaggctgcccaaaaggctgtgctagacttgcatggaaagtccatcgatggaaaagtcctctatgtagggcgagcacagaagaaaattgaacgcctggctgagttgaggcggagatttgaacggctgaggttaaaagaaaaaagtcggcccccaggggtgcctatctatattaagaacttggatgagacaatcaatgatgaaaaactgaaggaggaattttcttcctttgggtcaattagtcgggccaaagtgatgatggaagtggggcaaggcaaaggatttggtgtggtctgcttttcctcttttgaagaggctaccaaagcagtggatgagatgaatggccgcatagtgggctccaagcccctgcatgtcaccctgggccaggccaggcgcaggtgctgagaataagaatgctcagtttgtttcagccttagttggtgcctccttagtttgggctcctttgtgataaggggttattttatgctaattcacaagtttttttttgaagtgaattcttttgaaaaaaaaatgcaaaactagaaaactttattcattttagaatagaacataatttctaactgtaaaattgtcattttgtactttttttgatgtaatatccttagaaatctgtagaataaagtgtattcctccacttttttttcctgaacagtcaaggtgaggcaattgattgagtatatttcccttcttatttcagtaatactctattttttttcatgaaaatgtcaacatggttcttctgaatctatcacagtgaaaagttctaacttgtttttgagaagtcagtacagcaggggaaaacatatgtgatgcaattaacatctgcataatttcacttaaaattattatgcaaaaatgaatgttttttcaaaaaatgtgaaatgtattttattttctttatttgtattcttgtttcattttttaatatgttgtgaacatgctacagatttgatagtacttttgactaaatgttgggagtggtcgtattaacttcttgcccaaagaagtaagcatattggtgttttctcaattagtcactgagaaaattaacactttaggcagtggctatttaaagtaggaattgcatcttaaaaacctttcctaagagatttggtatgtgaggatactttcagtaccactcctaccattcatttttctaaattccttagtacatatacttggatcatgttaaattaacaagaaagatgaataactgcgctgaattgcctttacctataaataatttaatattttaccttcgggttttatcaactgtcaatataaaaggcagtactccacagaatgatgttgaaaaacttcttcgaagaacaccttctattaaacttgttatctcttgtaaattattgtgtgtgtccttttgataatattcacaggtgtttcaaaggtaaggaataggttgtctcttggattaagtcatatgcctccagccattatatgagaactgtgaaaccaatatggttttctttatgtcttggctgcttgaaaattaaaaaaaaaaaaggtttgttcaatattgccgttacatttattagcctgtaatttctaaattggagattctctacatttcacttgcagtttcctgttctcctcattgcctgccttccattcatattacacttatttttctattttttgtattacctttttaaaaatatataccagttcaagtccttttaggaagaagaaaatacctaatttatgtaaaatttaaataattacttttttataatatgattcacttatgccacagattcaacattagaatatgttttatctctactgtcagttttattaccttatatacaaatcttcattttcatacatagtacaatgtaaatatataactttgttaacacttttgttagctctttgaccataaaataatgacaataagctgtttctatgtatttgtttatctacaaattacaggtttatccatttgcaaatattttcaaaatggaaatcactgtttatattgattataaacataagacatgctcattgtaaaaaatgtacacaaggcagaaggaagtaaaatttccacagttcagaaataccacaattaatattttcaatgtgtaaatatcttttcataatttttcctacgtatacacaaacattttgaccaaaaatccacactatatgtactgttctgtatttttaattttaaactgaacaataatcatcttttcctgacaataaatatcaatctctatcatca

SEQ ID NO: 167096 - DNA, 1262 bp, Homo sapiens
  Payload ID: 12889
  Gene Symbol: PABPC5
  Gene Name: poly(A) binding protein, cytoplasmic 5
  ENST ID: ENST00000373105
  CDS Start-End: 332-988
cagaggaagcgggaagttacttagcacggttccgggtttctcgcgccccgcctgtcccccctccctatcactgctactggctcttggtccctccgttggactgtcctgcggagagaaaccccagcccatcggtctgcgctgggaccgcccgccgcgcatctgcccttcttcgctgactccgccccgcatctggccagacccgcctcgcgtcagagctgacccactcactgcgcgtttgccagtcagtctctccggacctgcctcgagcctcaggctgctgaaatcaccgcgcctcactcgcctggccgctgccaatagagccatctggcacatgaatggagtgcggctcaacaaccgccaggtgtatgttggcagattcaaattcccagaagagcgggcggctgaggtcagaaccagggatagagcaactttcaccaatgttttcgttaaaaacattggagacgacatagatgacgaaaaactgaaggaacttttctgtgaatatgggccaactgagagtgttaaagtaataagagatgccagtgggaaatctaaaggctttggatttgtgagatatgagacacacgaggctgcccaaaaggctgtgctagacttgcatggaaagtccatcgatggaaaagtcctctatgtagggcgagcacagaagaaaattgaacgcctggctgagttgaggcggagatttgaacggctgaggttaaaagaaaaaagtcggcccccaggggtgcctatctatattaagaacttggatgagacaatcaatgatgaaaaactgaaggaggaattttcttcctttgggtcaattagtcgggccaaagtgatgatggaagtggggcaaggcaaaggatttggtgtggtctgcttttcctcttttgaagaggctaccaaagcagtggatgagatgaatggccgcatagtgggctccaagcccctgcatgtcaccctgggccaggccaggcgcaggtgctgagaataagaatgctcagtttgtttcagccttagttggtgcctccttagtttgggctcctttgtgataaggggttattttatgctaattcacaagtttttttttgaagtgaattcttttgaaaaaaaaatgcaaaactagaaaactttattcattttagaatagaacataatttctaactgtaaaattgtcattttgtactttttttgatgtaatatccttagaaatctgtagaataaagtgtattcctccacttttttttcctgaacagtcaagg

SEQ ID NO: 167097 - DNA, 2001 bp, Homo sapiens
  Payload ID: 12890
  Gene Symbol: PABPN1
  Gene Name: poly(A) binding protein, nuclear 1
  Uniprot ID: Q86U42
  ENST ID: ENST00000216727
  CDS Start-End: 182-1102
cgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggtttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgttttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataaaaattgtttggccttttgggtgtaa

SEQ ID NO: 167098 - DNA, 2768 bp, Homo sapiens
  Payload ID: 12890
  Gene Symbol: PABPN1
  Gene Name: poly(A) binding protein, nuclear 1
  Uniprot ID: Q86U42
  ENST ID: ENST00000397276
  CDS Start-End: 14-904
agtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggtcaggatagatgggctgctcctctttcccccgcctcccgtgagccccgtatgcttcctcctctctggtctgaggaacctccctccccccacccctccccgtggtcttcaggaactttgtctcctgcctgtgcaggttgaggaaggtagttgcaggccaggccagaaggccagcctcatcatcttttctgcagtagaaattggtgataagggctgcatccctcccttggttcaaagaggcttccacccccagccttttttttcttgggagttggtggcatttgaaggtgtttgcggacaaaactgggaggaacagggcctccaggcagtgaaagcactgcttggacatttgttacttttttcggagttagggagggattgaagactgaacctcccttggaagaataccagaggctagctagttgatcctccccaacagccttgtgggaggattttgagatacttattctttatttgagccagtcttgcaaggttaacttctcactgggcctagtgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggtttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgttttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataaaaa

SEQ ID NO: 167099 - DNA, 778 bp, Homo sapiens
  Payload ID: 12890
  Gene Symbol: PABPN1
  Gene Name: poly(A) binding protein, nuclear 1
  ENST ID: ENST00000557702
  CDS Start-End: 193-699
gttgttctagagagggtagcttttcttttatcacgaccctcgcatggggcgagggaaatggccgagcatggctgaggccgcgctctggccgagagcagggcacagcccctgcgttggttcctcttaagctgtcctccataccctccccacttatattaggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggtcaggatagatgggctgctcctctttcccccgcctcccgtgagccccgtatgcttcctcctctctggtctgaggaacctccctccccc

SEQ ID NO: 167100 - DNA, 406 bp, Homo sapiens
  Payload ID: 12890
  Gene Symbol: PABPN1
  Gene Name: poly(A) binding protein, nuclear 1
  ENST ID: ENST00000555295
  CDS Start-End: 1-289
taccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggtcaggatagatgggctgctcctctttcccccgcctcccgggccgggctagagcgacatcatggtattccccttactaaaaaaagtgtgtattaggaggagagagaggaaaaaaagaggaaagaagg

SEQ ID NO: 167101 - DNA, 1220 bp, Homo sapiens
  Payload ID: 12890
  Gene Symbol: PABPN1
  Gene Name: poly(A) binding protein, nuclear 1
  ENST ID: ENST00000556821
  CDS Start-End: 672-1208
gccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggtgagggaaggagggcgagcgagcaggccggcggctggccggccgggtcactggaggcccagagctcgggcgagcgggtggcaggcggggggtggggttgggcggggaataacgtggctggggccgggtcgggccggggatgggtcagcgatcactacaaggggcccgactggcttgattcgggcgtcacggttgcctagtgttgttctagagagggtagcttttcttttatcacgaccctcgcatggggcgagggaaatggccgagcatggctgaggccgcgctctggccgagagcagggcacagcccctgcgttggttcctcttaagctgtcctccataccctccccacttatattaggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgta

SEQ ID NO: 167102 - DNA, 873 bp, Homo sapiens
  Payload ID: 12891
  Gene Symbol: PABPN1L
  Gene Name: poly(A) binding protein, nuclear 1-like (cytoplasmic)
  Uniprot ID: A6NDY0
  ENST ID: ENST00000411789
  CDS Start-End: 55-822
gaggggagtggaggggaggcctcgcctggcccaccttcctcctgcccctctaccatgtggcccttcccgagccgctctctcttcccacccccgactcaggcctggctccagacggtctcctcagaccctgaggcccagggctggggggcctggaacgagaccaaggagattctggggccagagggtggggaagggaaggaggagaaagaggaggaagaggatgcagaggaagaccaggatggggatgcaggctttctgctgtctctgctggagcaagagaacctggctgagtgcccattgcctgaccaggagctggaggccatcaagatgaaggtgtgtgccatggagcaggccgaggggacgccacggcctccaggagtgcagcaacaggccgaggaagaggagggcaccgcggccgggcagctgctgagccctgagaccgtgggctgccccctctctgggacccccgaggagaaggtggaggctgaccacagatccgtctacgtgggcaacgtggactacgggggctccgccgaggagctggaggcccacttcagccgctgtggggaggtccaccgagtcacgatcctgtgtgacaagttctctggacaccccaaggggtgctgccgaaaagaaccaacttccctgggatcagctccacagaccgcgggggccttcgaggacacccaggctccaggggggcacccttcccccacagcggcctccagggcaggccccggctcagaccacaagggcagaaccgggcccgtggaaaattctcaccatggttttcaccgtattaaagggaagacccgattttgagagaggggctggggcctggatcaggagtaaaccacttgtgctccatcctgg

SEQ ID NO: 167103 - DNA, 1272 bp, Homo sapiens
  Payload ID: 12891
  Gene Symbol: PABPN1L
  Gene Name: poly(A) binding protein, nuclear 1-like (cytoplasmic)
  Uniprot ID: A6NDY0
  ENST ID: ENST00000419291
  CDS Start-End: 13-849
tgcccctctaccatgtggcccttcccgagccgctctctcttcccacccccgactcaggcctggctccagacggtctcctcagaccctgaggcccagggctggggggcctggaacgagaccaaggagattctggggccagagggtggggaagggaaggaggagaaagaggaggaagaggatgcagaggaagaccaggatggggatgcaggctttctgctgtctctgctggagcaagagaacctggctgagtgcccattgcctgaccaggagctggaggccatcaagatgaaggtgtgtgccatggagcaggccgaggggacgccacggcctccaggagtgcagcaacaggccgaggaagaggagggcaccgcggccgggcagctgctgagccctgagaccgtgggctgccccctctctgggacccccgaggagaaggtggaggctgaccacagatccgtctacgtgggcaacgtggactacgggggctccgccgaggagctggaggcccacttcagccgctgtggggaggtccaccgagtcacgatcctgtgtgacaagttctctggacaccccaagggttatgcctacatagagtttgccaccaagggctccgtgcaggccgccgtggagctggaccagagcctcttccggggccgggtcatcaaggtgctgccgaaaagaaccaacttccctgggatcagctccacagaccgcgggggccttcgaggacacccaggctccaggggggcacccttcccccacagcggcctccagggcaggccccggctcagaccacaagggcagaaccgggcccgtggaaaattctcaccatggttttcaccgtattaaagggaagacccgattttgagagaggggctggggcctggatcaggagtaaaccacttgtgctccatcctggggctggggcagggagtggcgcgggggcgaggccagaggagaggggtgtccagagcagccactggccccctcttggcggggggatggcccagtagggccttgtatggtggtccagacccaaggccacagccacgagtcacagccacggcccggtggtgagcctggcatgggccccacggggatctgcggggctctgggtgttgagggaggggaggagcagagtcccaggcagtgccaggccagcttggggttggcatgctcagctcttcaactaagtcattttaagaaaaatagaaacgtgtgtcttaatggtgaagcataaattattaaacttgggctctttttaaaagcaaa

SEQ ID NO: 167104 - DNA, 854 bp, Homo sapiens
  Payload ID: 12891
  Gene Symbol: PABPN1L
  Gene Name: poly(A) binding protein, nuclear 1-like (cytoplasmic)
  ENST ID: ENST00000547152
  CDS Start-End: 55-854
gaggggagtggaggggaggcctcgcctggcccaccttcctcctgcccctctaccatgtggcccttcccgagccgctctctcttcccacccccgactcaggcctggctccagacggtctcctcagaccctgaggcccagggctggggggcctggaacgagaccaaggagattctggggccagagggtggggaagggaaggaggagaaagaggaggaagaggatgcagaggaagaccaggatggggatgcaggctttctgctgtctctgctggagcaagagaacctggctgagtgcccattgcctgaccaggagctggaggccatcaagatgaaggtgtgtgccatggagcaggccgaggggacgccacggcctccaggagtgcagcaacaggccgaggaagaggagggcaccgcggccgggcagctgctgagccctgagaccgtgggctgccccctctctgggacccccgaggagaaggtggaggctgaccacagatccgtctacgtgggcaacttatgcctacatagagtttgccaccaagggctccgtgcaggccgccgtggagctggaccagagcctcttccggggccgggtcatcaaggtgctgccgaaaagaaccaacttccctgggatcagctccacagaccgcgggggccttcgaggacacccaggctccaggggggcacccttcccccacagcggcctccagggcaggccccggctcagaccacaagggcagaaccgggcccgtggaaaattctcaccatggttttcaccgtattaaagggaagacccgattttgagagaggggctggggcctggatcaggagtaaaccacttgtgctccatcctgg

SEQ ID NO: 167105 - DNA, 4519 bp, Homo sapiens
  Payload ID: 12892
  Gene Symbol: PAPOLA
  Gene Name: poly(A) polymerase alpha
  Uniprot ID: P51003
  ENST ID: ENST00000216277
  CDS Start-End: 221-2458
agcagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaaacagcacaa

SEQ ID NO: 167106 - DNA, 2588 bp, Homo sapiens
  Payload ID: 12892
  Gene Symbol: PAPOLA
  Gene Name: poly(A) polymerase alpha
  ENST ID: ENST00000392990
  CDS Start-End: 36-2210
ggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgta

SEQ ID NO: 167107 - DNA, 3264 bp, Homo sapiens
  Payload ID: 12892
  Gene Symbol: PAPOLA
  Gene Name: poly(A) polymerase alpha
  Uniprot ID: P51003
  ENST ID: ENST00000557320
  CDS Start-End: 193-1050
gctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatggtatgtgtttagattatattaaaataaaattgattgtagacactgaagtttagtcttatttctatgacatttctcagcttggtttcagattcaaattttagttcatgatgtagtcatgtaggcagccttggagatcacattgtgtataaaatggcaaactgaaactattttttttccctagtttggccaggatagtaaggcagattctatttgtacttccttgcataaacttaccctctgaataaactctgaattttagcagctaagatccaatttattgataggttgggaaatcagttactatacttttggataaaacttgtacacactacctctttcactcttttaattctctatctataggccattagtttcttgtgattgttttttttttctttttgctttcagcatttatttggcctaatattaaagatacgaattttcataagaagcttttaaagaataaattaacattaagtgcttcgggacaaaaaaggaatttgagattagtcattaacccagatttttttaagtttcttcgtttcatttccacatatgtcaactatgatttaagaaaaagtagaataaaagattactgccattttatattaattgccttggcccaaaaggtgagggttcttggtttttaatcaaattaagataaatcgtccattcctgttcttatgaactcctgctcctccctctgcaaaagagatgttcttttctagtaattttataaaaattagttatttgagacaatttagagctgtgttcaactggaggaaaaataaaaaaaatttagaaccatgccacacttttcagtacacattctggctgttttgggatttagtagcacttataatcaggtgtgataagattaaagaatgtcagaatttcttttttttttttttttttttttgtttgagacggagtctcactctgtcacccaggctggagtgcagtggcacgatcttggctcactgcaagctctgcctcctggattcatgctattctcctgccttagtctcctgagtagctgggactacaagcgcctgccaccacgcctggctaatttttgtatttttagtagagacgaggtttcactgtgttagccaggatggtctcgatctcctgacctcataatccgcccgcctcggcctcccatagtgctgggattacaggcgtgagccaccgcgtccggctgtcagaatttcttttaatgctacacatatataagcaaataatgtttttaagaagctaaccttgatgttaagagtggcaggtgttctccagtttttacctctttcatatgggaccaaagtagctagtttatggaacacatatgaaaatgtggttatgccaccaagttttactactacacttgtcttaccacttttaagtcatgaattctataattattcatacccctttgcctgtgatcagaagtaacttttaaaattatcacttgactttggatggaactagtataaaggcaggaattttgtctttcagtggagatttattctgttcaaggttgaagtggacacatcattatcttgggatggtacttctttatttaaatagtcctttaaagttctttgagtggcagagaacgtttttggtttcagtctgagaaggctaccaaatggtttaagttcatttcatagttaggagaaaaagattttgagtagtctaatgtcgtcagaaaggattaaaacgttgtatgtaccaagaaggcagaatgaagaaggatcacgttcacaaatgctgtatgtttaacaaaatacgtttagatggtaatatccaatagtcttatcaagtgctacaatctttttaaacagggaatggccaaatccagtgctattgaaacagcctgaagaatgcaatcttaatttgcctgtatgggacccaagggttagtgtattattttttcccctaccaattcacactgtgcaataacaagtaaaaatcatctgcataaactccagggagacttccagccttttacttatgaatggtcatgtccgtattacactttcttttagataacctcaactataattgtcctcaactataattgatgtgagaagcataattatgtaccctgtaaaccacatttaattgtacatagtttttaatacagattttactaacattttaatttattctatatagaactaccttgtaagtcaaagttgtgtgggcatttgtgctttaaaaaaaataaaaggatact

SEQ ID NO: 167108 - DNA, 2272 bp, Homo sapiens
  Payload ID: 12892
  Gene Symbol: PAPOLA
  Gene Name: poly(A) polymerase alpha
  ENST ID: ENST00000555626
  CDS Start-End: 847-2272
tccggaattgctggcggaacctctaactcgcccggccactccagcttctccgccccgtccacaaagaaaatcaaaacaacccgaaaacaaaacattgcctggtgtccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctg

SEQ ID NO: 167109 - DNA, 892 bp, Homo sapiens
  Payload ID: 12892
  Gene Symbol: PAPOLA
  Gene Name: poly(A) polymerase alpha
  ENST ID: ENST00000553461
  CDS Start-End: 1-611
atgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggttagtgtattattttttcccctaccaattcacactgtgcaataacaagtaaaaatcatctgcataaactccagggagacttccagccttttacttatgaatggtcatgtccgtattacactttcttttagataacctcaactataattgtcctcaactataattgatgtgagaagcataattatgtaccctgtaaaccacatttaattgtacatagtttttaatacagattttactaacattttaatttattctatatagaactaccttgtaagtcaaagttgtgtgggcatttgtgctttaaaaaaaataaaaggatactaaaa

SEQ ID NO: 167110 - DNA, 1421 bp, Homo sapiens
  Payload ID: 12892
  Gene Symbol: PAPOLA
  Gene Name: poly(A) polymerase alpha
  ENST ID: ENST00000557471
  CDS Start-End: 153-869
cgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggtatgagaaagcctacttccttttgtgtacttcagtttttgtcagatattagttgtttttacacaagttttgtattgaagctttttatagctatattgttaacacagtagtgagttaaataaaatgaactttgcctaataaactacagaagagtatgtagtagtttatttcactctacagtattttatacactgtatttcttctgtcattaatggtatactcaggacacttaaaaagaccatctgacttttgtactctgttgctagtgatttaggtttcatggcctaacccaaattaattttgatcctgttattctttagtaatgctttcagcattgctgagatcagaaggactactttggtacaattttatattagcatagcttgttactgtgctcttgaagagcagttcttggaaactttagtggattaagtcttccgcagtatatgtgggaagttttaattgtgaatctgaagttcaaattggggcaggttacagtttactttggtttctttggtcagtgcttacaataggagataaatgctttagattttttccccctctttattgaattagctttactggttctaccaaataaaaatttatgtttacttttaacttcaatctcagaaaatttggaagcattaccattaaacttttga

SEQ ID NO: 167111 - DNA, 584 bp, Homo sapiens
  Payload ID: 12892
  Gene Symbol: PAPOLA
  Gene Name: poly(A) polymerase alpha
  ENST ID: ENST00000556619
  CDS Start-End: 52-584
cggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcagtaatgatctggaatacttgattgataattgttttatcaacaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggat

SEQ ID NO: 167112 - DNA, 2267 bp, Homo sapiens
  Payload ID: 12892
  Gene Symbol: PAPOLA
  Gene Name: poly(A) polymerase alpha
  ENST ID: ENST00000553689
  CDS Start-End: 196-531
agcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggt

SEQ ID NO: 167113 - DNA, 959 bp, Homo sapiens
  Payload ID: 12892
  Gene Symbol: PAPOLA
  Gene Name: poly(A) polymerase alpha
  ENST ID: ENST00000556459
  CDS Start-End: 1-542
atgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttatt

SEQ ID NO: 167114 - DNA, 585 bp, Homo sapiens
  Payload ID: 12892
  Gene Symbol: PAPOLA
  Gene Name: poly(A) polymerase alpha
  ENST ID: ENST00000553357
  CDS Start-End: 1-221
agaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgttaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagg

SEQ ID NO: 167115 - DNA, 4262 bp, Homo sapiens
  Payload ID: 12893
  Gene Symbol: PAPOLB
  Gene Name: poly(A) polymerase beta (testis specific)
  Uniprot ID: Q9NRJ5
  ENST ID: ENST00000404991
  CDS Start-End: 185-2098
atgttggggctgaggggaaggaggagaagctcctgaagcggcgggcgcgcagcgggagtgggagtggggtcggaccagggcagctagaagccctgcccttccgcctcagcggatcatgacccgggcggcggccgcgaaggtcgcggtggtgggggacgtgccctggcggggcgggcgctgaaagatgatgccgtttccggtgacaacccagggaccaccgcagccggcgccgccgccgaatcgctacggcgtctcctcgcctatcagtctagcggtccccaaggagacggactgcctcctcacccagaggctaatagaaaccctcaggcccttcggggtcttcgaagaggaagaggaactgcagcgcaggattttagttttggaaaaattaaataatctggtaaaggaatggatacgcgaaatcagtgaaagcaagagtcttccccagtctgtaattgaaaacgttggaggaaagatttttacgtttggctcttacagattaggagtacatacgaaaggcgcagatattgacgccttgtgcgttgcaccaagtcatgtggatcgaagcgactttttcacctcattctatgctaaactgaaactacaggaggaagtgaaagatttaagggctgtcgaggaggcatttgtgccagttatcaaactgtgttttgatgggatagagattgatattttatttgcaagattagcactacagactattccagaagatttggacttaagagatgacagtctacttaaaaatttagacattagatgcataagaagccttaatggttgccgggtaaccgatgaaattttacatctagtgccaaacattgacaacttcaggctgactctgagagccatcaaactgtgggccaagtgccacaatatctattccaatatattaggtttcctcggaggtgtttcctgggccatgctagtagcaagaacttgtcagctttatccaaatgcagtagcgtcaactcttgtacggaaattcttcttggtattttcagaatgggaatggccaaacccagtgttactgaaggagcctgaagaacggaatcttaatttgcctgtatgggacccaagagtaaatcccagtgataggtaccatcttatgcctatcatcacaccagcatacccacagcagaactccacatacaacgtgtctatttcaaccaggatggtcatgattgaggagtttaaacaggggcttgctatcacacacgagattttgctaagtaaggcagagtggtccaaactctttgaagctccaagcttctttcaaaagtacaagcattatattgtacttctggcaagtgcatcaacagaaaaacaacatttagaatgggtgggcttggtggaatcaaagatccgaatcctggttgggagcttggagaagaatgaatttattacactggcacatgtgaatccacagtcatttccagcacccaaagaaaatcctgatatggaagaatttcgtacaatgtgggtgattgggttagggctaaaaaagccagataattctgaaattctcagcattgatctcacctatgatatccagtctttcacagatactgtttataggcaagcagtgaatagtaagatgtttgagatgggtatgaaaattactgcaatgcatttaagaagaaaggaacttcaccagctgctgcctcatcatgtgcttcaggacaagaaagcacactcaacagaaggtagaagattgacagatttgaacgacagcagctttgacttgtctgcaggctgtgaaaacagcatgtctgtgccttcatctactagcactatgaagacaggcccattgattagcagttctcagggtagaaacagtcctgccttggctgtaatgacagcatctgtggctaacatacaggctactgaattttccttgcaacaggtgaataccaatgaaagttcaggggttgcattaaacgaaagtattcctcacgctgtctctcagcctgccatttctccatcaccaaaggccatggtcgccagagttgtttcttcaacatgtctcataagccatccagaccttcaggaaactcagcaacaaacatatctaatcctatagttggagtctagaggatattcttgcctcataaagaagaaaggaccaagaaaaccaaaacggaagaggagaaactcaatacaaagacaagtacaactccattagaaaaattcagacagcatcttctctattggcctctcagggaacatcagtatagatctttccggtatccctgttctccctgcaaatccaattcctgttatcaagaattcagtaaaacaggttgaatggttaaaaacaacctcaagggtccatgaacaatatctgccaactgaacctgttgtcttcaaatactaaggaaggagaatgaggggtacgggactagatatgacttgaaatagattgaggctcatttggtaacttcctttactgagccagtcttgatcagaagtccacattagtatgtgacagctagaggtactgttattaatgtatcagcaacagttacattaactatttcaaaggactactgcccttaaaatgaaaaaacctttcagctatgtttgtacccgtgactgacatctggactggatttatgcttgatgcattgttgggaaaatatgcaatacaaactggtatcagaattccttatactgatgaggcactttatattttttattagaaagtagaactaattttagatttttcaaattggtgaattttatttttccctgaagaggtttcttcactattaatcttaaaattggataccattgtgcagcggtgtactgtacttcagagaaagcataaaagtacatctagctcagtccctatgaggtagctgtaaccctttaaaatgaaatgtcaactttaaggtatgtttttgacatcaaccattagtaggtctttggttttgatggcacactatggagaaaggacacactggttttaatctgtagaactgttttagagtaattagcaatcaaacattttctttgagctatcaaagctccatattctcttgtcctcaatcattagtcctaaaacaaaaaagctttttgcctccctctcttctctttgcctgtatgcacacagtatgcttatgtgtcatttcacaagaaaaaaggaataatattctctaaaccatgatgtgaaactgacaatcctgtggccacatggcacaaaacaccaaatattggttatgatgaaacaccacattttagcaaaactttactaaatgtaatgtctatgagatatgtttctgatcttggatgaccatttgatcactgcatatgagaagttttgttcattccacagaatacctccttataggaaagttaatttccaattgcacacataagcaaaaaggcattttcttcaagaattttaaacacttttatttttaaacgatttatcaaaattcatctctaaattttacatgtagaaacataaaaaagtaatttctagcaagcacttgacatcttactggctttctgctcttttagtctacaaaagatcagcaatactttaagttaaaaaaaatctcataattaagcagtagagcatctatgattaggaaatgtgaggggcaacagatgtgaatgaatgaaagttgagtctttcttaatctagacagcaaacttaacaggctttccaattagccttgctttaacccctcccgtccctcctctaactctgcacttttcatgttaaactgcaattacttaaactcttttcctgtcctgcattaattttccaaagttggaatatagtcatgtccttttatgctgtagagacttttctttcaccattactttctgatatctagtacacagtatttctttttctcacatctttgccgtttcaccacaataataaatcgggtgaagtgtgcacaatatctgtattttgaatggctatggcgttaggttgaaatggccaggcacaaatttagtctggtcattttgtttacacattgggaaaaaaattagtttattaaacattacctgtaactgtgtctgttttaccaagctggaaccttgggactttttatttctaatttttattacctgaatgtcagaccattttttcatgtgatgtacctagtgagtggagtttgctttgttttatggtatctgtactcctggtatattcaagcactgttttgaaaacagatgacttatttctccattaaaaatgcaataaaaataaatggcaaacaagcaaa

SEQ ID NO: 167116 - DNA, 4263 bp, Homo sapiens
  Payload ID: 12894
  Gene Symbol: PAPOLG
  Gene Name: poly(A) polymerase gamma
  Uniprot ID: Q9BWT3
  ENST ID: ENST00000238714
  CDS Start-End: 250-2460
ctgagacctgcgagaggcaggctgggaagcggcgccatattggcgtcggccgcgctgtattgtcataaatagagccggttttgtggtgttttcactactcggttggatgcctcagccatagtaagtgggaaagtgagcgagcaagcgagctactagcgaccggaggaaagtgaacagggggagaagggaacagcaagaacaggactccagagcgataaacactcgctggagagggagacgcaggaagcgatgaaagagatgtctgcaaacaccgtgctggacagccagcgtcaacaaaagcattatggaattacctccccaattagtttggcatctcctaaagaaattgatcatatttacacacagaaattaattgacgccatgaaaccatttggagtgtttgaagatgaggaagaattgaaccacaggctggtggttcttggtaaattgaacaatttagtaaaagaatggatttctgatgtcagcgagagtaagaacctcccaccttctgttgtggctactgttggtggtaaaattttcacatttggatcctataggcttggagtacacaccaaaggagctgacattgatgcactttgtgtagctccaagacatgtggaaagatctgatttttttcagtctttttttgaaaaattgaaacatcaagatggcattagaaacttaagagctgtagaagatgcctttgtacctgttataaaatttgaatttgatggtattgaaattgatctagtctttgcaagactggcaatacaaaccatatcagataatttagatctaagagacgactctcgcctgagaagccttgatataaggtgtattcgcagcttaaatggttgtagagttactgatgaaattttgcatttagtgccaaataaagaaacttttagactcaccctaagagctgtcaaattatgggcaaaacgacgtggtatttattccaacatgctaggattccttggtggtgtctcctgggcaatgctagttgcaagaacttgccaattgtatccaaatgcagcagcatctactttagttcataagttctttttagttttttccaagtgggaatggccaaatcctgtgctgctgaagcaaccagaagaaagcaatttgaatttgcctgtctgggatcctcgggtaaatccatcagataggtatcatctcatgcccataatcacccctgcctacccacaacagaattctacgtataatgtgtccacatcaactcgaacagtaatggtagaagaatttaaacaaggtcttgcagtcacagatgaaattcttcaaggaaagtcagattggtccaaactacttgagccaccgaatttctttcaaaagtatagacattatatagtattgactgccagcgcatcaacagaagaaaaccatctagagtgggttggattagtagaatctaaaatccgtgtacttgttggaaacttggaacggaatgaatttattactcttgcccatgtgaatccccagtcattcccagggaataaggaacatcataaagacaacaattacgtatcaatgtggttccttgggataatttttcggagagtagaaaatgcagaaagtgtcaacatagacttgacatatgatatacagtcatttactgatacagtgtacagacaggcaaacaatataaatatgctaaaggagggaatgaaaattgaagcaactcatgtaaagaaaaaacaacttcaccactaccttcctgcagaaattcttcaaaagaagaaaaagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggaatagtgctgagcctgctgctgtaattgtggagaagccactgagtgtaccaccagcccaaggactttccattccagtgattggcgcaaaagttgactctacagtaaaaactgtatcaccccccactgtgtgtaccattcctaccgtagtaggacgaaatgtcattcctagaatcacaacacctcacaaccctgcccagggacaaccgcatctgaatggaatgtcaaatataactaagactgttacacctaagagatcccattccccatccatagatgggactcctaagaggttgaaagacgtagaaaagtttattcgacttgaatcaacatttaaggacccccgcactgctgaagaaagaaaaagaaaatcagtggatgccattggaggagaatctatgcctattccaactattgatacatcacgcaaaaagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgtttttctttttttgtcttatgttgtaatcattgtatagagctaaaaaaattgaaaacaaacaaaaaaattgtcttgtattttccaaatgttaatacatttactttagcattgaagccactttgaaacctgagataaatgaatgtgaggtatcttttctgctttcctcatttgtgtagatgtactgtctgttctgttgatttaaattatttttttccagattggcacatgaaatatttaaacttttttgtgtgcctttctgtccaaatgttgcatagttaccagggaagattagtccagtgattacataagagttgggcaccataaattctctatattttgcctcccatggaggcctttgaaatgcatctttattaaaaatcaaaatataaccaggatactgaaagtcagtatatgaatggtaaaattgttacatatcctatttcatgccattcttgttagttgactggtattttttactgaggagcaactcattccagcatcaacaataagataacctttaagtatggcacacttgtatttttgaggtgtaaaattaacttggcatgataattcctgatcattatttaccccacaacttcaaatagtttcttcacggactaggcatgcagaaataagcagtggattttattgaaacctaaaggcattttgaatgacattgttaccaaccattaattggctcaggacctttgtaatttttatttaactatatgagttgtctttttttacgctgcttttttcaatgcatttcttaatattttttaagtttcatgaatgcatgctcagtttattaaaatccataaccatgtaattcttgtaatatgttgattcagtgttttgtaaatgaagtcgtatgtattttcagagtatttttgtatgtactgtaagataccatcttttcaaagagaaacgtttaaaacctttattgtctctccttagtctaattttttaaatatggattatgcttgaattactatatttaaaatgaaaatgtatagattacacagccaggaatgctagtatctaccaccttctttagatttcactcagcatttagtaggtccagtaggaaaaacccaaaatggtacattgagtagtgtggggaagacacctcgtgtattataggactcacgggatgccatctagcaagtggagaaatagcagtccattttctcttgcaagccctttaccattgagttgaaattcttgaattgccagagagccgtatcctccaggtcccactcctgttcattgccccttaggtctccaaaatgtaaattctaatgtttaccttgtaccatggaaaacatgaaaagagtcttagaagtaaagaacaacaaggaaaaaaatgtttgttctattattccctttttatatagcagcaaaagataagaataaaatcacataaccaagttgaa

SEQ ID NO: 167117 - DNA, 6074 bp, Homo sapiens
  Payload ID: 12894
  Gene Symbol: PAPOLG
  Gene Name: poly(A) polymerase gamma
  ENST ID: ENST00000412217
  CDS Start-End: 1-1149
cgaacagtaatggtagaagaatttaaacaaggtcttgcagtcacagatgaaattcttcaaggaaagtcagattggtccaaactacttgagccaccgaatttctttcaaaagtatagacattatatagtattgactgccagcgcatcaacagaagaaaaccatctagagtgggttggattagtagaatctaaaatccgtgtacttgttggaaacttggaacggaatgaatttattactcttgcccatgtgaatccccagtcattcccagggaataaggaacatcataaagacaacaattacgtatcaatgtggttccttgggataatttttcggagagtagaaaatgcagaaagtgtcaacatagacttgacatatgatatacagtcatttactgatacagtgtacagacaggcaaacaatataaatatgctaaaggagggaatgaaaattgaagcaactcatgtaaagaaaaaacaacttcaccactaccttcctgcagaaattcttcaaaagaagaaaaagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggaatagtgctgagcctgctgctgtaattgtggagaagccactgagtgtaccaccagcccaaggactttccattccagtgattggcgcaaaagttgactctacagtaaaaactgtatcaccccccactgtgtgtaccattcctaccgtagtaggacgaaatgtcattcctagaatcacaacacctcacaaccctgcccagggacaaccgcatctgaatggaatgtcaaatataactaagactgttacacctaagagatcccattccccatccatagatgggactcctaagaggttgaaagacgtagaaaaggatgccattggaggagaatctatgcctattccaactattgatacatcacgcaaaaagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgtttttctttttttgtcttatgttgtaatcattgtatagagctaaaaaaattgaaaacaaacaaaaaaattgtcttgtattttccaaatgttaatacatttactttagcattgaagccactttgaaacctgagataaatgaatgtgaggtatcttttctgctttcctcatttgtgtagatgtactgtctgttctgttgatttaaattatttttttccagattggcacatgaaatatttaaacttttttgtgtgcctttctgtccaaatgttgcatagttaccagggaagattagtccagtgattacataagagttgggcaccataaattctctatattttgcctcccatggaggcctttgaaatgcatctttattaaaaatcaaaatataaccaggatactgaaagtcagtatatgaatggtaaaattgttacatatcctatttcatgccattcttgttagttgactggtattttttactgaggagcaactcattccagcatcaacaataagataacctttaagtatggcacacttgtatttttgaggtgtaaaattaacttggcatgataattcctgatcattatttaccccacaacttcaaatagtttcttcacggactaggcatgcagaaataagcagtggattttattgaaacctaaaggcattttgaatgacattgttaccaaccattaattggctcaggacctttgtaatttttatttaactatatgagttgtctttttttacgctgcttttttcaatgcatttcttaatattttttaagtttcatgaatgcatgctcagtttattaaaatccataaccatgtaattcttgtaatatgttgattcagtgttttgtaaatgaagtcgtatgtattttcagagtatttttgtatgtactgtaagataccatcttttcaaagagaaacgtttaaaacctttattgtctctccttagtctaattttttaaatatggattatgcttgaattactatatttaaaatgaaaatgtatagattacacagccaggaatgctagtatctaccaccttctttagatttcactcagcatttagtaggtccagtaggaaaaacccaaaatggtacattgagtagtgtggggaagacacctcgtgtattataggactcacgggatgccatctagcaagtggagaaatagcagtccattttctcttgcaagccctttaccattgagttgaaattcttgaattgccagagagccgtatcctccaggtcccactcctgttcattgccccttaggtctccaaaatgtaaattctaatgtttaccttgtaccatggaaaacatgaaaagagtcttagaagtaaagaacaacaaggaaaaaaatgtttgttctattattccctttttatatagcagcaaaagataagaataaaatcacataaccaagttgaagcttccttggcaaagctgttgtcttagctgactctttccctttattcagatgttttgggattgttctacaaatagtctatttgagcaaaaatgaatgattatgaaagaaccgaagaattatcacctgacttcaacttttgaaagctttagtaaggaatttgattaaattttatatactggatgtgtatgcatttctgcatttcatatcttttgcttttaaatcagccttcaaagtatctttaggaattccttctgtatccatgtttaccccattatgtaaatagatctttggagtgactagtggagtttttctttaataaggaagcaacaagtctaaccttgtactataggataggcatttattttagattaaggagcccattcaacatgtcaatgagtcaacattagagtcctcaaagatagcattcttcaacctgtttggtaactgaggagttgataaaatacttttgagatggtggggtttgtcagaaataaaatattttctatcctgaccagtaggtagaactttgagtacatttcgttaacttggtgggaagcttccattgtactagttccaagtaaaaaaggagaaagtatgatctgggattttgtgttatgatgagaggcactaagtacatgtgtttgttttgttttgttttgttttgttttgttttgtttgagacagagttttgctcttgttgcccaggctggagtgcagtagcccaatctcggctcactgcaaccttcacctcccgagttcaagctattctcttgcctcagcctcccaagtagctgggattacaggcacccaccacctcgcccagctaatttttgtatttttagtacagacagcgtttcaccatgttggccaggctggtctcgaacttgtgacctcaggtgatccacctgcctcggcgtcccaaagtgctgggattacaggcgtgaaccaccgcacccggccgtgtttgttttcaagtgtgaaaaaatacctagaagtatattttatgaagtcaaataatctgttcttcagtatatagacacatgttcattttcacaagggcattacattttaatttgctcatttttcagtagctctggagaatatgtatgaaaggaaaacaattacctgctagcttaaaccttagggacttaaccaattcaagatagaggtacatggcttaaaactttgtaaaactgggacaggagaattattatttttttattttttatttttttatgaagacaagagtttcactctgtcacccagtctggagcacagtggcatgatctcacctcactgcaacctctgcctcccgggttcaagtgattctcttgcctcagcctcccaagtagctggaattacaggcctgtgccatgcccagctaattttcgtattttcagtagaaatgggatttcaccatgttggccagggtggtcttgaactcctcacctcaagtgatctggctgcttcggccaccctaagtgctgggattacaggcataagctactgtgcccagccaggagaatgaattttaaaaatctatgttagtgtttaaaatgagtgctttgttttaaagcagcaatttagtagcattattaaaatgcttacttcactatagtagcaattaggtaaagatgggcaatatcaaaatgggctaaacttattttccactatgttccacacctttgaaataggaattcctaacttgagaatcatgaacccttagggaatcctttataattgtgtataagaagttctagtttacatgcatttttcttggggaaagtgcatagtttagatcagcttctcgaagtggcaaaagtatgggagttagggttaggaaccaccaggattgaataatcctggaatattatataattttctacttttgattttgctgtggtatatttctgaaaatgtgctgtggctcctaactagtaaaatgggctggtgagggactctggaattctgaatttctaagtttataacctaaaatgaaactgtaaagtcctcggtatttagaaaaatgcttaatctcagatttacagatggcctcatgataacttagattcgttaacagggtcaaactttagttcaacaaatttcaacccaatattatcacagtacaatagcttagaatgatcattagaaatggtagaaaatagaataaatcattaaagatcccaaaatgttgagttctgtagcatgaaaactctcttgctcctccatgtttgtagttcaggccagaacaaactaaacagaccaataaatataaaagtgatagtttagggaaaaaaaaaaactttgtataaataaaattgtatgtgtgttcaaataactacctattaaatcatccaaagcttagaatttaaattggtcatagtagcaaatagtgcagatgatggaagaaaaccagtctcaataatggttttttttttccaattgcataaggtcacgtcatcccccaaattgtctattttttcttttctttttttttaagatggagtctcgctccgtcacccaggctggaatgcagtggcgcaatcttggctcattgcaacctccacctcccaggtgcaagcgattctcctacctcagcctcccaagtagctgggactacaggcgcccgccaccatgtgggcctggctaatttttgtagagatggggtttcaacatgttggccaggctggtctcaaactcctgacctccagtgatgcacccgcctcggcctcccaaagttctgggattacaggcgtgagccaccgtgcccagcccctattttttctgaaataatttttcggatatacttttatatttgaaattagttgaacataagatgatcatcaagcttgctataagttttaagctattgctacatttgaacaaagacccacgtacttatcttagaaagtacttaggatatctttgagattaatggtgctacatcactctacagtactatgtaaaatgaatggagctgctgttcctttctagctagctgtttgtgtagttcatattaatttaccctgccttttatttggattgtctgatttcttagttgtacacatgaacctcattatttgcctggaataagtaatcaaataaaattgctttgataaat

SEQ ID NO: 167118 - DNA, 3511 bp, Homo sapiens
  Payload ID: 12894
  Gene Symbol: PAPOLG
  Gene Name: poly(A) polymerase gamma
  ENST ID: ENST00000414060
  CDS Start-End: 200-904
atattggcgtcggccgcgctgtattgtcataaatagagccggttttgtggtgttttcactactcggttggatgcctcagccataaaacaccgtgctggacagccagcgtcaacaaaagcattatggaattacctccccaattagtttggcatctcctaaagaaattgatcatatttacacacagaaattaattgacgccatgaaaccatttggagtgtttgaagatgaggaagaattgaaccacaggctggtggttcttggtaaattgaacaatttagtaaaagaatggatttctgatgtcagcgagagtaagaacctcccaccttctgttgtggctactgttggtggtaaaattttcacatttggatcctataggcttggagtacacaccaaaggagctgacattgatgcactttgtgtagctccaagacatgtggaaagatctgatttttttcagtctttttttgaaaaattgaaacatcaagatggcattagaaacttaagagctgtagaagatgcctttgtacctgttataaaatttgaatttgatggtattgaaattgatctagtctttgcaagactggcaatacaaaccatatcagataatttagatctaagagacgactctcgcctgagaagccttgatataaggtgtattcgcagcttaaatggttgtagagttactgatgaaattttgcatttagtgccaaataaagaaacttttagactcaccctaagagctgtcaaattatgggcaaaacgacgtggtatttattccaacatgctaggattccttggtggtgtctcctgggcaatgctagttgcaagaacttgccaattgtatccaaatgcagcagcatctactttagttcataagttctttttagttttttccaagtggtaaatccatcagataggtatcatctcatgcccataatcacccctgcctacccacaacagaattctacgtataatgtgtccacatcaactcgaacagtaatggtagaagaatttaaacaaggtcttgcagtcacagatgaaattcttcaaggaaagtcagattggtccaaactacttgagccaccgaatttctttcaaaagtatagacattatatagtattgactgccagcgcatcaacagaagaaaaccatctagagtgggttggattagtagaatctaaaatccgtgtacttgttggaaacttggaacggaatgaatttattactcttgcccatgtgaatccccagtcattcccagggaataaggaacatcataaagacaacaattacgtatcaatgtggttccttgggataatttttcggagagtagaaaatgcagaaagtgtcaacatagacttgacatatgatatacagtcatttactgatacagtgtacagacaggcaaacaatataaatatgctaaaggagggaatgaaaattgaagcaactcatgtaaagaaaaaacaacttcaccactaccttcctgcagaaattcttcaaaagaagaaaaagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggaatagtgctgagcctgctgctgtaattgtggagaagccactgagtgtaccaccagcccaaggactttccattccagtgattggcgcaaaagttgactctacagtaaaaactgtatcaccccccactgtgtgtaccattcctaccgtagtaggacgaaatgtcattcctagaatcacaacacctcacaaccctgcccagggacaaccgcatctgaatggaatgtcaaatataactaagactgttacacctaagagatcccattccccatccatagatgggactcctaagaggttgaaagacgtagaaaagtttattcgacttgaatcaacatttaaggacccccgcactgctgaagaaagaaaaagaaaatcagtggatgccattggaggagaatctatgcctattccaactattgatacatcacgcaaaaagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgtttttctttttttgtcttatgttgtaatcattgtatagagctaaaaaaattgaaaacaaacaaaaaaattgtcttgtattttccaaatgttaatacatttactttagcattgaagccactttgaaacctgagataaatgaatgtgaggtatcttttctgctttcctcatttgtgtagatgtactgtctgttctgttgatttaaattatttttttccagattggcacatgaaatatttaaacttttttgtgtgcctttctgtccaaatgttgcatagttaccagggaagattagtccagtgattacataagagttgggcaccataaattctctatattttgcctcccatggaggcctttgaaatgcatctttattaaaaatcaaaatataaccaggatactgaaagtcagtatatgaatggtaaaattgttacatatcctatttcatgccattcttgttagttgactggtattttttactgaggagcaactcattccagcatcaacaataagataacctttaagtatggcacacttgtatttttgaggtgtaaaattaacttggcatgataattcctgatcattatttaccccacaacttcaaatagtttcttcacggactaggcatgcagaaataagcagtggattttattgaaacctaaaggcattttgaatgacattgttaccaaccattaattggctcaggacctttgtaatttttatttaactatatgagttgtctttttttacgctgcttttttcaatgcatttcttaatattttttaagtttcatgaatgcatgctcagtttattaaaatccataaccatgtaattcttgtaatatgttgattcagtgttttgtaaatgaagtcgtatgtattttcagagtatttttgtatgtactgtaagataccatcttttcaaagagaaacgtttaaaacc

SEQ ID NO: 167119 - DNA, 3324 bp, Homo sapiens
  Payload ID: 12894
  Gene Symbol: PAPOLG
  Gene Name: poly(A) polymerase gamma
  ENST ID: ENST00000453839
  CDS Start-End: 1-507
aacaccgtgctggacagccagcgtcaacaaaagcattatggaattacctccccaattagtttggcatctcctaaagaaattgatcatatttacacacagaaattaattgacgccatgaaaccatttggagtgtttgaagatgaggaagaattgaaccacaggctggtggttcttggtaaattgaacaatttagtaaaagaatggatttctgatgtcagcgagagtaagaacctcccaccttctgttgtggctactgttggtggtaaaattttcacatttggatcctataggcttggagtacacaccaaaggagctgacattgatgcactttgtgtagctccaagacatgtggaaagatctgatttttttcagtctttttttgaaaaattgaaacatcaagatggcattagaaacttaagagctgtagaagatgcctttgtacctgttataaaatttgaatttgatggtattgaagttgtagagttactgatgaaattttgcatttagtgccaaataaagaaacttttagactcaccctaagagctgtcaaattatgggcaaaacgacgtggtatttattccaacatgctaggattccttggtggtgtctcctgggcaatgctagttgcaagaacttgccaattgtatccaaatgcagcagcatctactttagttcataagttctttttagttttttccaagtgggaatggccaaatcctgtgctgctgaagcaaccagaagaaagcaatttgaatttgcctgtctgggatcctcgggtaaatccatcagataggtatcatctcatgcccataatcacccctgcctacccacaacagaattctacgtataatgtgtccacatcaactcgaacagtaatggtagaagaatttaaacaaggtcttgcagtcacagatgaaattcttcaaggaaagtcagattggtccaaactacttgagccaccgaatttctttcaaaagtatagacattatatagtattgactgccagcgcatcaacagaagaaaaccatctagagtgggttggattagtagaatctaaaatccgtgtacttgttggaaacttggaacggaatgaatttattactcttgcccatgtgaatccccagtcattcccagggaataaggaacatcataaagatgtacagacaggcaaacaatataaatatgctaaaggagggaatgaaaattgaagcaactcatgtaaagaaaaaacaacttcaccactaccttcctgcagaaattcttcaaaagaagaaaaagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggaatagtgctgagcctgctgctgtaattgtggagaagccactgagtgtaccaccagcccaaggactttccattccagtgattggcgcaaaagttgactctacagtaaaaactgtatcaccccccactgtgtgtaccattcctaccgtagtaggacgaaatgtcattcctagaatcacaacacctcacaaccctgcccagggacaaccgcatctgaatggaatgtcaaatataactaagactgttacacctaagagatcccattccccatccatagatgggactcctaagaggttgaaagacgtagaaaagtttattcgacttgaatcaacatttaaggacccccgcactgctgaagaaagaaaaagaaaatcagtggatgccattggaggagaatctatgcctattccaactattgatacatcacgcaaaaagaagcagttggatgctcagcacattaatttcttaccaagcacctggagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgtttttctttttttgtcttatgttgtaatcattgtatagagctaaaaaaattgaaaacaaacaaaaaaattgtcttgtattttccaaatgttaatacatttactttagcattgaagccactttgaaacctgagataaatgaatgtgaggtatcttttctgctttcctcatttgtgtagatgtactgtctgttctgttgatttaaattatttttttccagattggcacatgaaatatttaaacttttttgtgtgcctttctgtccaaatgttgcatagttaccagggaagattagtccagtgattacataagagttgggcaccataaattctctatattttgcctcccatggaggcctttgaaatgcatctttattaaaaatcaaaatataaccaggatactgaaagtcagtatatgaatggtaaaattgttacatatcctatttcatgccattcttgttagttgactggtattttttactgaggagcaactcattccagcatcaacaataagataacctttaagtatggcacacttgtatttttgaggtgtaaaattaacttggcatgataattcctgatcattatttaccccacaacttcaaatagtttcttcacggactaggcatgcagaaataagcagtggattttattgaaacctaaaggcattttgaatgacattgttaccaaccattaattggctcaggacctttgtaatttttatttaactatatgagttgtctttttttacgctgcttttttcaatgcatttcttaatattttttaagtttcatgaatgcatgctcagtttattaaaatccataaccatgtaattcttgtaatatgttgattcagtgttttgtaaatgaagtcgtatgtattttcagagtatttttgtatgtactgtaagataccatcttttcaaagagaaacgtttaaaacc

SEQ ID NO: 167120 - DNA, 2100 bp, Homo sapiens
  Payload ID: 12895
  Gene Symbol: PARN
  Gene Name: poly(A)-specific ribonuclease
  Uniprot ID: O95453
  ENST ID: ENST00000341484
  CDS Start-End: 252-1988
gcagcaggcgcgcgctgtttccggaagtcgcggccggcgtcaccgctgcggctgcctcagctactgccgcagtcgccgcggaattcgattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaagcattccatggactttttgctatttcagtttggcctttgcacttttaagtatgactacacagattcaaagtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggtt

SEQ ID NO: 167121 - DNA, 3078 bp, Homo sapiens
  Payload ID: 12895
  Gene Symbol: PARN
  Gene Name: poly(A)-specific ribonuclease
  Uniprot ID: O95453
  ENST ID: ENST00000437198
  CDS Start-End: 143-2062
gcgcgctgtttccggaagtcgcggccggcgtcaccgctgcggctgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaagcattccatggactttttgctatttcagtttggcctttgcacttttaagtatgactacacagattcaaagtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcagccctcggttagtctcccagtggaaaaatcggttgtgcctccctgcttcccaccatagctgcctgaaaacatgacgctctcaagcttgtccttccttcaggaagatgtccactcatgcccacccatgagagggcttgccgtatgccctggcctttgggcatatttatgtagagttcctttctcctaagacgtgagtttctcatgggggatgtacgagtaaaaaggttaacttctgttcttatgcgtggcgctgtgttcactttccagagtctctgttcgtttgtttggatggcggtctcggggtacggcagcgtgtgtgcgtacgtgtctgtgtgtgtgtgtgtgtgtgtgtgtgtgtgtgtgtgtgtgtgtgtgtgaaatcgtgcaaatctacaacatgtcccagcccattctccgttgaaacagatcacagcaacgacaaacgctcatggcgctgctttgctccacccgcttcagatagatcattgttagatatttcacatttttgtatggtggaaataaaaatgaaaaatgtatttccaaaagatgaaaattaaaaacattttcatagga

SEQ ID NO: 167122 - DNA, 2360 bp, Homo sapiens
  Payload ID: 12895
  Gene Symbol: PARN
  Gene Name: poly(A)-specific ribonuclease
  Uniprot ID: O95453
  ENST ID: ENST00000420015
  CDS Start-End: 135-1916
tttccggaagtcgcggccggcgtcaccgctgcggctgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcag

SEQ ID NO: 167123 - DNA, 1557 bp, Homo sapiens
  Payload ID: 12895
  Gene Symbol: PARN
  Gene Name: poly(A)-specific ribonuclease
  Uniprot ID: O95453
  ENST ID: ENST00000539279
  CDS Start-End: 114-1508
gtcaccgctgcggctgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaaccaagacctgagggcagcaaaccgctggtgctgtcgctgtgagcaagag

SEQ ID NO: 167124 - DNA, 808 bp, Homo sapiens
  Payload ID: 12895
  Gene Symbol: PARN
  Gene Name: poly(A)-specific ribonuclease
  ENST ID: ENST00000538472
  CDS Start-End: 94-717
agctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaagcattccatggactttttgctatttcagtttggcctttgcacttttaagtatgactacacagattcaaaatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaaaaggagcgatatatagttatcagcaaagtagatgaagaagaacgcaaaagaagagagcagcagaaacatgccaaagaacaggaggagctgaatgatgctgtgggatt

SEQ ID NO: 167125 - DNA, 783 bp, Homo sapiens
  Payload ID: 12895
  Gene Symbol: PARN
  Gene Name: poly(A)-specific ribonuclease
  ENST ID: ENST00000569444
  CDS Start-End: 1-783
aggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagact

SEQ ID NO: 167126 - DNA, 577 bp, Homo sapiens
  Payload ID: 12895
  Gene Symbol: PARN
  Gene Name: poly(A)-specific ribonuclease
  ENST ID: ENST00000562896
  CDS Start-End: 249-577
agtcacagcccaaggggtgacgggtgtgtgtcagtttccgctcctcctgggcggctgttcttgtatccggaggatacaagctttgcctagaaattaaaatattacaaggccgcaccgtactctctacagttattttttgccttcacattttatgtagaaaatcacaggactatacgttcaatttacggtgttaagaatcggaattaaatgacttttatttctattaaaatattttttttttcgtagagatggggtctcgctgcgttttccaggctgatcttgaacatatggcgtcaagggatcctcctgcctcagccttacaaagtgctgcgattacagattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaagcattccatggactttttgctatttcagtttggcctttgcacttttaagtatgactacacagattcaaagtatataacgaa

SEQ ID NO: 167127 - DNA, 1029 bp, Homo sapiens
  Payload ID: 12895
  Gene Symbol: PARN
  Gene Name: poly(A)-specific ribonuclease
  ENST ID: ENST00000563641
  CDS Start-End: 136-333
gtttccggaagtcgcggccggcgtcaccgctgcggctgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaaggtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccag

SEQ ID NO: 167128 - DNA, 3078 bp, Homo sapiens; identical to SEQ ID NO: 167121
  Payload ID: 12895
  Gene Symbol: PARN
  Gene Name: poly(A)-specific ribonuclease
  Uniprot ID: O95453
  ENST ID: ENST00000615183
  CDS Start-End: 143-2062

SEQ ID NO: 167129 - DNA, 2360 bp, Homo sapiens; identical to SEQ ID NO: 167122
  Payload ID: 12895
  Gene Symbol: PARN
  Gene Name: poly(A)-specific ribonuclease
  Uniprot ID: O95453
  ENST ID: ENST00000618929
  CDS Start-End: 135-1916

SEQ ID NO: 167130 - DNA, 2100 bp, Homo sapiens; identical to SEQ ID NO: 167120
  Payload ID: 12895
  Gene Symbol: PARN
  Gene Name: poly(A)-specific ribonuclease
  Uniprot ID: O95453
  ENST ID: ENST00000634004
  CDS Start-End: 252-1988

SEQ ID NO: 167131 - DNA, 808 bp, Homo sapiens; identical to SEQ ID NO: 167124
  Payload ID: 12895
  Gene Symbol: PARN
  Gene Name: poly(A)-specific ribonuclease
  ENST ID: ENST00000634095
  CDS Start-End: 94-717

SEQ ID NO: 167132 - DNA, 783 bp, Homo sapiens; identical to SEQ ID NO: 167125
  Payload ID: 12895
  Gene Symbol: PARN
  Gene Name: poly(A)-specific ribonuclease
  ENST ID: ENST00000632860
  CDS Start-End: 1-783

SEQ ID NO: 167133 - DNA, 1029 bp, Homo sapiens; identical to SEQ ID NO: 167127
  Payload ID: 12895
  Gene Symbol: PARN
  Gene Name: poly(A)-specific ribonuclease
  ENST ID: ENST00000632226
  CDS Start-End: 136-333

SEQ ID NO: 167134 - DNA, 577 bp, Homo sapiens; identical to SEQ ID NO: 167126
  Payload ID: 12895
  Gene Symbol: PARN
  Gene Name: poly(A)-specific ribonuclease
  ENST ID: ENST00000633129
  CDS Start-End: 249-577

SEQ ID NO: 167135 - DNA, 1557 bp, Homo sapiens; identical to SEQ ID NO: 167123
  Payload ID: 12895
  Gene Symbol: PARN
  Gene Name: poly(A)-specific ribonuclease
  Uniprot ID: O95453
  ENST ID: ENST00000631868
  CDS Start-End: 114-1508

SEQ ID NO: 167136 - DNA, 1921 bp, Homo sapiens
  Payload ID: 12896
  Gene Symbol: PNLDC1
  Gene Name: poly(A)-specific ribonuclease (PARN)-like domain containing 1
  ENST ID: ENST00000275275
  CDS Start-End: 40-159
acgtgatagcgctgggcgactccgcggagctgcacggccatggacgtgggcgccgacgagttcgaggagagcctccctctgctgcaggagctcgtccaggaggccgacttcgtggaggtgagcgcgggtgccttggccgcctgcagatctacagtgtgaggagtgctggcgatgttctgcacccgaggactgctattttttgccttcctggcaggtctggacatagagttcacgggccttcgttctaacctgtctgggccccagcagatcagtctttttgatttgccatcggagtggtatctaaagacccgtcagagtgttcagcaatttacagtctgtcagattggattgtctgtgttttccgctattgaaggagaggcaaacaagtatatagcccattcttgtaacttctatctcttccctacaacgtttgggattttggactcagaattctccttccaggcttccagtgttcagtttttgaatcagtatggcttcaactataacaagtttctcaaaaacggaatcccatatatgaatgaagaacaggagaagaaaattagacacgatatcctgactgggaactggagagttcgcagctctccggataaagaccaaatcaaggtggtgattgacgaagtgacgcggtggctggagctggccaaggaaggcgactggatgactcttcctgggatcactggcttccaggcctttgaggtccaactggtgctgaggcaggccctccccaacatctggacggtgctgaaagatgagggggtggtagtgaagaaagtgagtaaacaacatcgttggtatcttcagaacacctcttgtgaccgagagagctgttggaaggaaaatattcttctctcagcaaggggtttttctgtctttttccaaatgctggtgaaagcccagaagcccttagtgggacataatatgatgatggacctgctgcacctccatgagaagttcttcagacccctcccagaaagctacgatcaatttaagcagaatatccacagcctatttcctgttctcattgataccaagagtgtaacaaaggatatctggaaggagatgaatttcccgagggtgtcgaatctttcggaagtctatgaagtcctgaacagtgacttgaatcccaccaagaattctggaccagagattgttcacgcgagcaggtgtgagaaatatgttgagacaaagtgcccccacgaagccgcgtatgatgccttcctctgtgggtcagttcttttgaaagtggcacacttgcttctacagaagatataccacatcgaccccgtgcccgagtcatcctttcctcagtaccttgacgtgctggctccttacgtgaaccaagtgaacctcatccgagcgggggtcccaaagatcaatttttctggtccagattatcccagtatccgacctcccatcctcatcctcagcgtcaaaaggtggcctggggtcagcgagcagcaagtctaccataagtttcagaatctctgcaagtttgatgtcaggcgactcacaagaagccagttcttactcctgaccaataagtttaaggatgcgcggaacatcctgaaggagtaccgggaccacccgaccctgtgcatctccctgtaccgctactggaggcactccccaaacgtcaactgcctgctccaagtctgtggcatagtgactgcctgggcccttctcgcgttcatccttggaagatctggtacctgagtgcagcgaggcctcctgcggccaccctcgggtccccatgctctctgggaggtgtgctgggtgtgttcgtgtaaatcagattctgtttgcagatggatctgtttggtcttttctagaaattctgttatgtcctgaacgtgaaattctgtcaacactctcaatgataaatcagtccttagatatcgta

SEQ ID NO: 167137 - DNA, 1816 bp, Homo sapiens
  Payload ID: 12896
  Gene Symbol: PNLDC1
  Gene Name: poly(A)-specific ribonuclease (PARN)-like domain containing 1
  Uniprot ID: Q8NA58
  ENST ID: ENST00000392167
  CDS Start-End: 35-1630
atagcgctgggcgactccgcggagctgcacggccatggacgtgggcgccgacgagttcgaggagagcctccctctgctgcaggagctcgtccaggaggccgacttcgtgggtctggacatagagttcacgggccttcgttctaacctgtctgggccccagcagatcagtctttttgatttgccatcggagtggtatctaaagacccgtcagagtgttcagcaatttacagtctgtcagattggattgtctgtgttttccgctattgaaggagaggcaaacaagtatatagcccattcttgtaacttctatctcttccctacaacgtttgggattttggactcagaattctccttccaggcttccagtgttcagtttttgaatcagtatggcttcaactataacaagtttctcaaaaacggaatcccatatatgaatgaagaacaggagaagaaaattagacacgatatcctgactgggaactggagagttcgcagctctccggataaagaccaaatcaaggtggtgattgacgaagtgacgcggtggctggagctggccaaggaaggcgactggatgactcttcctgggatcactggcttccaggcctttgaggtccaactggtgctgaggcaggccctccccaacatctggacggtgctgaaagatgagggggtggtagtgaagaaagtgagtaaacaacatcgttggtatcttcagaacacctcttgtgaccgagagagctgttggaaggaaaatattcttctctcagcaaggggtttttctgtctttttccaaatgctggtgaaagcccagaagcccttagtgggacataatatgatgatggacctgctgcacctccatgagaagttcttcagacccctcccagaaagctacgatcaatttaagcagaatatccacagcctatttcctgttctcattgataccaagagtgtaacaaaggatatctggaaggagatgaatttcccgagggtgtcgaatctttcggaagtctatgaagtcctgaacagtgacttgaatcccaccaagaattctggaccagagattgttcacgcgagcaggtgtgagaaatatgttgagacaaagtgcccccacgaagccgcgtatgatgccttcctctgtgggtcagttcttttgaaagtggcacacttgcttctacagaagatataccacatcgaccccgtgcccgagtcatcctttcctcagtaccttgacgtgctggctccttacgtgaaccaagtgaacctcatccgagcgggggtcccaaagatcaatttttctggtccagattatcccagtatccgacctcccatcctcatcctcagcgtcaaaaggtggcctggggtcagcgagcagcaagtctaccataagtttcagaatctctgcaagtttgatgtcaggcgactcacaagaagccagttcttactcctgaccaataagtttaaggatgcgcggaacatcctgaaggagtaccgggaccacccgaccctgtgcatctccctgtaccgctactggaggcactccccaaacgtcaactgcctgctccaagtctgtggcatagtgactgcctgggcccttctcgcgttcatccttggaagatctggtacctgagtgcagcgaggcctcctgcggccaccctcgggtccccatgctctctgggaggtgtgctgggtgtgttcgtgtaaatcagattctgtttgcagatggatctgtttggtcttttctagaaattctgttatgtcctgaacgtgaaattctgtcaacactctcaatgataaatcagtccttagatatcgt

SEQ ID NO: 167138 - DNA, 1940 bp, Homo sapiens
  Payload ID: 12896
  Gene Symbol: PNLDC1
  Gene Name: poly(A)-specific ribonuclease (PARN)-like domain containing 1
  Uniprot ID: Q8NA58
  ENST ID: ENST00000610273
  CDS Start-End: 192-1754
gtgggcagcacgtgggcagcacgtgatagcgctgggcgactccgcggagctgcacggccatggacgtgggcgccgacgagttcgaggagagcctccctctgctgcaggagctcgtccaggaggccgacttcgtggaggtgagcgcgggtgccttggccgcctgcagatctacagtgtgaggagtgctggcgatgttctgcacccgaggactgctattttttgccttcctggcaggtctggacatagagttcacgggccttcgttctaacctgtctgggccccagcagatcagtctttttgatttgccatcggagtggtatctaaagacccgtcagagtgttcagcaatttacagtctgtcagattggattgtctgtgttttccgctattgaaggagaggcaaacaagtatatagcccattcttgtaacttctatctcttccctacaacgtttgggattttggactcagaattctccttccaggcttccagtgttcagtttttgaatcagtatggcttcaactataacaagtttctcaaaaacggaatcccatatatgaatgaagaacaggagaagaaaattagacacgatatcctgactgggaactggagagttcgcagctctccggataaagaccaaatcaaggtggtgattgacgaagtgacgcggtggctggagctggccaaggaaggcgactggatgactcttcctgggatcactggcttccaggcctttgaggtccaactggtgctgaggcaggccctccccaacatctggacggtgctgaaagatgagggggtggtagtgaagaaagtgagtaaacaacatcgttggtatcttcagaacacctcttgtgaccgagagagctgttggaaggaaaatattcttctctcagcaaggggtttttctgtctttttccaaatgctggtgaaagcccagaagcccttagtgggacataatatgatgatggacctgctgcacctccatgagaagttcttcagacccctcccagaaagctacgatcaatttaagcagaatatccacagcctatttcctgttctcattgataccaagagtgtaacaaaggatatctggaaggagatgaatttcccgagggtgtcgaatctttcggaagtctatgaagtcctgaacagtgacttgaatcccaccaagaattctggaccagagattgttcacgcgagcaggtgtgagaaatatgttgagacaaagtgcccccacgaagccgcgtatgatgccttcctctgtgggtcagttcttttgaaagtggcacacttgcttctacagaagatataccacatcgaccccgtgcccgagtcatcctttcctcagtaccttgacgtgctggctccttacgtgaaccaagtgaacctcatccgagcgggggtcccaaagatcaatttttctggtccagattatcccagtatccgacctcccatcctcatcctcagcgtcaaaaggtggcctggggtcagcgagcagcaagtctaccataagtttcagaatctctgcaagtttgatgtcaggcgactcacaagaagccagttcttactcctgaccaataagtttaaggatgcgcggaacatcctgaaggagtaccgggaccacccgaccctgtgcatctccctgtaccgctactggaggcactccccaaacgtcaactgcctgctccaagtctgtggcatagtgactgcctgggcccttctcgcgttcatccttggaagatctggtacctgagtgcagcgaggcctcctgcggccaccctcgggtccccatgctctctgggaggtgtgctgggtgtgttcgtgtaaatcagattctgtttgcagatggatctgtttggtcttttctagaaattctgttatgtcctgaacgtgaaattctgtcaacactctcaatgataaatcagtccttagatatcgt

SEQ ID NO: 167139 - DNA, 578 bp, Homo sapiens
  Payload ID: 12896
  Gene Symbol: PNLDC1
  Gene Name: poly(A)-specific ribonuclease (PARN)-like domain containing 1
  ENST ID: ENST00000610048
  CDS Start-End: 38-157
gtgatagcgctgggcgactccgcggagctgcacggccatggacgtgggcgccgacgagttcgaggagagcctccctctgctgcaggagctcgtccaggaggccgacttcgtggaggtgagcgcgggtgccttggccgcctgcagatctacagtgtgaggagtgctggcgatgttctgcacccgaggactgctattttttgccttcctggcaggtctggacatagagttcacgggccttcgttctaacctgtctgggccccagcagatcaggattgtctgtgttttccgctattgaaggagaggcaaacaagtatatagcccattcttgtaacttctatctcttccctacaacgtttgggattttggactcagaattctccttccaggcttccagtgttcagtttttgaatcagtatggcttcaactataacaagtttctcaaaaacggaatcccatatatgaatgaagaacaggagaagaaaattagacacgatatcctgactgggaactggagagttcgcagctctccggataaagaccaaatcaaggtggtgattgacgaagtgacgcggtggctg

SEQ ID NO: 167140 - DNA, 965 bp, Homo sapiens
  Payload ID: 12896
  Gene Symbol: PNLDC1
  Gene Name: poly(A)-specific ribonuclease (PARN)-like domain containing 1
  ENST ID: ENST00000610041
  CDS Start-End: 43-162
agcacgtgatagcgctgggcgactccgcggagctgcacggccatggacgtgggcgccgacgagttcgaggagagcctccctctgctgcaggagctcgtccaggaggccgacttcgtggaggtgagcgcgggtgccttggccgcctgcagatctacagtgtgaggagtgctggcgatgttctgcacccgaggactgctattttttgccttcctggcaggtctggacatagagttcacgggccttcgttctaacctgtctgggccccagcagatcagtctttttgatttgccatcggagtggtatctaaagacccgtcagagtgttcagcaatttacagtctgtcagattggattgtctgtgttttccgctattgaaggagaggcaaacaagtatgtatcaagagcttctgcaaacataggtgcttcccacctatgttccacagctgccaccttcaaattctgcctcaggtatatagcccattcttgtaacttctatctcttccctacaacgtttgggattttggactcagaattctccttccaggcttccagtgttcagtttttgaatcagtatggcttcaactataacaagtttctcaaaaacggaatcccatatatgaatgaagaacaggagaagaaaattagacacgatatcctgactgggaactggagagttcgcagctctccggataaagaccaaatcaaggtggtgattgacgaagtgacgcggtggctggagctggccaaggaaggcgactggatgactcttcctgggatcactggcttccaggcctttgaggtccaactggtgctgaggcaggccctccccaacatctggacggtgctgaaagatgagggggtggtagtgaagaaagtgagtaaacaacatcgttggtatcttcagaacacctcttgtgaccgagagagctgttggaaggaaaatattcttctctcagcaaggggttt

SEQ ID NO: 167141 - DNA, 1750 bp, Homo sapiens
  Payload ID: 12897
  Gene Symbol: PCBP1
  Gene Name: poly(rC) binding protein 1
  Uniprot ID: Q15365
  ENST ID: ENST00000303577
  CDS Start-End: 291-1361
aaagcgggcttcccgccccgcccagaccgccgaggctgccgccggagtcgccaccgccgcgccctcgcccacccgcccgcccgccgctcccggccccgctcgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaatgcttcatatttgaaaaagctgggaattgctgtcttaaa

SEQ ID NO: 167142 - DNA, 1730 bp, Homo sapiens
  Payload ID: 12898
  Gene Symbol: PCBP2
  Gene Name: poly(rC) binding protein 2
  Uniprot ID: Q15366
  ENST ID: ENST00000359282
  CDS Start-End: 351-1346
cccagaccagcagaggcagcagccggagcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgcc

SEQ ID NO: 167143 - DNA, 1814 bp, Homo sapiens
  Payload ID: 12898
  Gene Symbol: PCBP2
  Gene Name: poly(rC) binding protein 2
  Uniprot ID: Q15366
  ENST ID: ENST00000359462
  CDS Start-End: 324-1424
gcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtg

SEQ ID NO: 167144 - DNA, 2741 bp, Homo sapiens
  Payload ID: 12898
  Gene Symbol: PCBP2
  Gene Name: poly(rC) binding protein 2
  Uniprot ID: Q15366
  ENST ID: ENST00000455667
  CDS Start-End: 65-1021
cacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaacctcagaggggaggacccagccttagcctccctcctcccaagtgcaaaatgtgtaaacagagtaaacggaacagaaaagtgcagtctaagtggttttctctcctgcccctcccaccgcccctccccccaccccctattatttggggataaagaatataaagacaaccctggcttttctattgccttgttgcttgctgaatataaggaatggggtggggcaggaaggggcttgcccttagccacagctctacggctgtgcctcattcatttccacagctgccagtgtccctagagtttatcaggtgaattggtcaggggatcagtctccctcgagcctgacttacggctgggacagccccatctttctgttgattatgtggcgcatatatatatatatatgtatatatatataatttatataaatatttctctatgta

SEQ ID NO: 167145 - DNA, 3026 bp, Homo sapiens
  Payload ID: 12898
  Gene Symbol: PCBP2
  Gene Name: poly(rC) binding protein 2
  Uniprot ID: Q15366
  ENST ID: ENST00000437231
  CDS Start-End: 351-1307
cccagaccagcagaggcagcagccggagcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaacctcagaggggaggacccagccttagcctccctcctcccaagtgcaaaatgtgtaaacagagtaaacggaacagaaaagtgcagtctaagtggttttctctcctgcccctcccaccgcccctccccccaccccctattatttggggataaagaatataaagacaaccctggcttttctattgccttgttgcttgctgaatataaggaatggggtggggcaggaaggggcttgcccttagccacagctctacggctgtgcctcattcatttccacagctgccagtgtccctagagtttatcaggtgaattggtcaggggatcagtctccctcgagcctgacttacggctgggacagccccatctttctgttgattatgtggcgcatatatatatatatatgtatatatatataatttatataaatatttctctatgt

SEQ ID NO: 167146 - DNA, 3077 bp, Homo sapiens
  Payload ID: 12898
  Gene Symbol: PCBP2
  Gene Name: poly(rC) binding protein 2
  Uniprot ID: Q15366
  ENST ID: ENST00000447282
  CDS Start-End: 351-1358
cccagaccagcagaggcagcagccggagcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaacctcagaggggaggacccagccttagcctccctcctcccaagtgcaaaatgtgtaaacagagtaaacggaacagaaaagtgcagtctaagtggttttctctcctgcccctcccaccgcccctccccccaccccctattatttggggataaagaatataaagacaaccctggcttttctattgccttgttgcttgctgaatataaggaatggggtggggcaggaaggggcttgcccttagccacagctctacggctgtgcctcattcatttccacagctgccagtgtccctagagtttatcaggtgaattggtcaggggatcagtctccctcgagcctgacttacggctgggacagccccatctttctgttgattatgtggcgcatatatatatatatatgtatatatatataatttatataaatatttctctatgt

SEQ ID NO: 167147 - DNA, 1296 bp, Homo sapiens
  Payload ID: 12898
  Gene Symbol: PCBP2
  Gene Name: poly(rC) binding protein 2
  Uniprot ID: Q15366
  ENST ID: ENST00000439930
  CDS Start-End: 23-1120
gctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattggggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctc

SEQ ID NO: 167148 - DNA, 681 bp, Homo sapiens
  Payload ID: 12898
  Gene Symbol: PCBP2
  Gene Name: poly(rC) binding protein 2
  ENST ID: ENST00000551104
  CDS Start-End: 208-681
ctagtcgagggaagggggggctttttttcttaagtggaaaatgcttggataaccgaggggagagggggctgcggagttaaagaaagggtagacgggctcccagttgccgagttaatcaggacgtttctcgggtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgt

SEQ ID NO: 167149 - DNA, 823 bp, Homo sapiens
  Payload ID: 12898
  Gene Symbol: PCBP2
  Gene Name: poly(rC) binding protein 2
  ENST ID: ENST00000546652
  CDS Start-End: 1-609
ggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagacgagtctcactgttttgctcaggctggtctccaactcctgagcttccgatgattcgactgccttggtctcccaaagtgctcggattacagatagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagagttgaccaagctgcaccagttggcaatgcaacagtctcattttcccatgacgcatggcaacaccgg

SEQ ID NO: 167150 - DNA, 1619 bp, Homo sapiens
  Payload ID: 12898
  Gene Symbol: PCBP2
  Gene Name: poly(rC) binding protein 2
  ENST ID: ENST00000549863
  CDS Start-End: 327-1292
ggagcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcagttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttt

SEQ ID NO: 167151 - DNA, 734 bp, Homo sapiens
  Payload ID: 12898
  Gene Symbol: PCBP2
  Gene Name: poly(rC) binding protein 2
  ENST ID: ENST00000550192
  CDS Start-End: 543-734
gaaccgtttattttttcccccctctttctagtcgagggaagggggggctttttttcttaagtggaaaatgcttggataaccgaggggagagggggctgcggagttaaagaaagggtagacgggctcccagttgccgagttaatcaggacgtttctcggggtaacgaatttttaaattacaaaatgcctgccgatgtaatcccagaccgagctatttatggaaggggtattggacagcagtgttagcagctggattgctggaatggggtacctttatcttgacctagtcaggagggaaattcgacaaatttcttggattacttggtttggagttagaaatgcatctttgtactttacctcaagaaatggcttcaaataggtttcctgttttgttttttttttttttgccttttcgaagttgcgttattgtgatatttgtaaagggcttcctattacatctgcaagaggtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggaccc

SEQ ID NO: 167152 - DNA, 1786 bp, Homo sapiens
  Payload ID: 12898
  Gene Symbol: PCBP2
  Gene Name: poly(rC) binding protein 2
  ENST ID: ENST00000553064
  CDS Start-End: 1-933
agtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcagtttagaaaacgctaaaccctcctcccaggcagcctccgtcacgatccctgatcacctcagcatcaacctctctcaaccctccaccccttcttcttcttcctcctccaccaccaccccctcgctcgccacagcggggacctccgacgcaccctccagcctccccaaccctcttccgaccgccccttgtgtctccagtctgcttggcatgaaacccatccctctcctggctctaaatgttgtgtctgctgctaagggtaccggggcttcagctaccaccaccaccacctctgccgtgccatgtgtaactaacaaactgaaaggcgagaaacagagattctctccctactgattgcataccttgaggcacctcctccagtattattttgttcattttgttttcctttgttaacattggtgagaatgaaactattgtgagcttgttaccgtttcctttttactactttgggggataactgggtgggggtgggggagtggtaacccttgtttaggtttaggccatttcagctgagtgcctgtttcagggtctgacttgaattctttatctagagccacagttttctcttctttcttgtttgttacttttctttgtagctttattctgccttgcaatataacaatgtgttaggctctgtgttaatgaataaaagctgcttcgttaacttttttttttttttttaagaattatttaatggttaagctatcagcaggccttcttggccatatttgtgtttctagctgtaataaagttggcgcagtaagaaccttagtacactgtgtgctgtgaagggtaaagggttgggggcttgtgacttgtggctattcagctaggaagcctgtataactgacatgggctttttgaatcccaagtgaattttatagtcgtttgtcaatatttccacaaagagataacgagtctgtggcagtttagatcctgaaggtcctctgtaattggcaacaagcttcactagtgaggaagtttatctgacttctcagatggccttaccttgccagcagcagctaacaaggtgttcatcccaggattcctctggtgaatggttaccatgaggatctcttccaagtcatacattcaaagaacatacttctttacccagaatgaaggggaggggcaaagtgggataagtctaataaaattaggcagcttctgtctgcattcctctgaa

SEQ ID NO: 167153 - DNA, 1457 bp, Homo sapiens
  Payload ID: 12898
  Gene Symbol: PCBP2
  Gene Name: poly(rC) binding protein 2
  Uniprot ID: Q15366
  ENST ID: ENST00000546463
  CDS Start-End: 128-1216
cttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttt

SEQ ID NO: 167154 - DNA, 753 bp, Homo sapiens
  Payload ID: 12898
  Gene Symbol: PCBP2
  Gene Name: poly(rC) binding protein 2
  ENST ID: ENST00000550520
  CDS Start-End: 274-753
ccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggag

SEQ ID NO: 167155 - DNA, 1342 bp, Homo sapiens
  Payload ID: 12898
  Gene Symbol: PCBP2
  Gene Name: poly(rC) binding protein 2
  Uniprot ID: Q15366
  ENST ID: ENST00000552296
  CDS Start-End: 85-1170
cgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattggggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctt

SEQ ID NO: 167156 - DNA, 1202 bp, Homo sapiens
  Payload ID: 12898
  Gene Symbol: PCBP2
  Gene Name: poly(rC) binding protein 2
  Uniprot ID: Q15366
  ENST ID: ENST00000548933
  CDS Start-End: 17-1024
cagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctg

SEQ ID NO: 167157 - DNA, 1418 bp, Homo sapiens
  Payload ID: 12898
  Gene Symbol: PCBP2
  Gene Name: poly(rC) binding protein 2
  Uniprot ID: Q15366
  ENST ID: ENST00000552819
  CDS Start-End: 68-1036
tttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatg

SEQ ID NO: 167158 - DNA, 2543 bp, Homo sapiens
  Payload ID: 12898
  Gene Symbol: PCBP2
  Gene Name: poly(rC) binding protein 2
  ENST ID: ENST00000550585
  CDS Start-End: 1-338
tggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagaggctggagtgcagtggcgcagtcatggctcactgcagcaaaacatcgaccttcccagcctcaggcgatcctctcatctcagcctcccaaggagccgggactgcaggctcccaccaccacacccaaatttttgtatttttttgtaaaaatggtgttttgccatgtggcccaggctggtttcgaactcctgagctcaagcaatccacccacctcaggctcccagtgttattactacaggcttgagccagcacacttgcttgcctgcagcgtcatttttcttgaccagacttataaacaacaaggagaaaaataggaagatgtattgggaaatagatgtaattctacatctttttttttttttttgagacagggtctcactcaggctgaagtgcagggcataatcgtgatcatggcttactgcaacctcgacttctgggctcatgtaaccctcctacctcaagcctcctgagtacctggtaccataggcgcgctccacaatgcccggctaatttttcttctttctgttgttgtagagacgagtctcactgttttgctcaggctggtctccaactcctgagcttccgatgattcgactgccttggtctcccaaagtgctcggattacagatgtgagccactgtgcctggcccctacttcctgtttaactatggaagttacgttgaattatggaagattttaattgtatctagatgttactgaatttggtgttggaatgaaactcgaatggctgcttgagtttttgggagcgtatcgtacatggcacgacagagatcttaattttgttaattgctatattcgaagcacttctcatggtacctggcacatagaatggccttgatgtaaatattttttcagtaacataatgaaaggtgggtgatacttgtggggcttttgcttcgcccagagaactatcattagttgaaaggcaactatttagaaggaccttttgcttgagagtaggttaaatttaggctgttattcacgcttattcttgtctttcagtggctaatttatttttaactctaattcactaaacagtcctatctggaataagggaagagtgggacaaagaacaaaaagggaagattggaaatggataaatatctactagagttttaggctctgaaattgctgctggaggaattggaagagcatgaactgtttttctctgattttgaatttctttttactccaaagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttatt

SEQ ID NO: 167159 - DNA, 1145 bp, Homo sapiens
  Payload ID: 12898
  Gene Symbol: PCBP2
  Gene Name: poly(rC) binding protein 2
  ENST ID: ENST00000562264
  CDS Start-End: 1-904
gcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcagttgaccaagctgcaccagttggcaatgcaacagtctcattttcccatgacgcatggcaacaccggattcagtggcattgaatccagctctccagaggtgaaaggctattggggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttt

SEQ ID NO: 167160 - DNA, 527 bp, Homo sapiens
  Payload ID: 12898
  Gene Symbol: PCBP2
  Gene Name: poly(rC) binding protein 2
  ENST ID: ENST00000552980
  CDS Start-End: 418-527
aggtgtttctgaattctttgaagctttttctgctgaaggacaagtggtgcacgttcagcagtttccttagaaccattgccaattgaaagaaccttgttcatcctgagagtcagcggaaaccctgtcattaatgagaggaactggaaagttgccttctatactgtgtaacagaacctgagctgtatattttgtcatgcagttgtgcttggtgtgtatataagtctgacatactgtcatttaaggaaaagtgtaaagtagaaaatattgataaggtgaaaataacttgggaaataataaccttgttgttttcctcctctgattttggtcatgtttgcattttagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaa

SEQ ID NO: 167161 - DNA, 1919 bp, Homo sapiens
  Payload ID: 12898
  Gene Symbol: PCBP2
  Gene Name: poly(rC) binding protein 2
  ENST ID: ENST00000547859
  CDS Start-End: 1-554
tgttggagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaacctcagaggggaggacccagccttagcctccctcctcccaagtgcaaaatgtgtaaacagagtaaacggaacagaaaagtgc

SEQ ID NO: 167162 - DNA, 1086 bp, Homo sapiens
  Payload ID: 12899
  Gene Symbol: PCBP3
  Gene Name: poly(rC) binding protein 3
  ENST ID: ENST00000400304
  CDS Start-End: 1-1086
atggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggtaagagccgatccgctcgcggcctccactgccaacctcagccttttactgcagcacccgccgctgcccgcctacacaatccagggacagtatgccatccctcacccggatttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaa

SEQ ID NO: 167163 - DNA, 1717 bp, Homo sapiens
  Payload ID: 12899
  Gene Symbol: PCBP3
  Gene Name: poly(rC) binding protein 3
  ENST ID: ENST00000400305
  CDS Start-End: 1-969
cctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggaggcctacacaatccagggacagtatgccatccctcacccggatcagttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctca

SEQ ID NO: 167164 - DNA, 1911 bp, Homo sapiens
  Payload ID: 12899
  Gene Symbol: PCBP3
  Gene Name: poly(rC) binding protein 3
  Uniprot ID: P57721
  ENST ID: ENST00000400308
  CDS Start-End: 126-1163
gtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggaggcctacacaatccagggacagtatgccatccctcacccggatttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctca

SEQ ID NO: 167165 - DNA, 1986 bp, Homo sapiens
  Payload ID: 12899
  Gene Symbol: PCBP3
  Gene Name: poly(rC) binding protein 3
  Uniprot ID: P57721
  ENST ID: ENST00000400309
  CDS Start-End: 126-1238
gtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctca

SEQ ID NO: 167166 - DNA, 2168 bp, Homo sapiens
  Payload ID: 12899
  Gene Symbol: PCBP3
  Gene Name: poly(rC) binding protein 3
  Uniprot ID: P57721
  ENST ID: ENST00000400310
  CDS Start-End: 365-1420
gtacacgccatggtgtgggagcagcctgaccatcgggactcaggagcttacagaattttctggggtttcgatactctagaggtttcccctggttacttggcgaatattctatgaaaatgaagagaatgaagtgaagtcagagtcatttactcagaatgcaccctactgtaaatggagaggatgctacttggagtgtgtggtctgtataaatggagaggatgcatatgaagttacaaagggtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatcagttgaccaagctccaccagttggccatgcagcaaaccccctttcctcccctcggacagaccaaccccgctttccccggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctca

SEQ ID NO: 167167 - DNA, 2202 bp, Homo sapiens
  Payload ID: 12899
  Gene Symbol: PCBP3
  Gene Name: poly(rC) binding protein 3
  Uniprot ID: P57721
  ENST ID: ENST00000400314
  CDS Start-End: 339-1454
tcgggctggagcgcctgaagccgcgaccgccgcctcagccgcctcagccgcggtcgccgccgcttcggctgacttaggctccgccgccgcctcctcacccgcctcgccccgaccccgcccgggcctcccggcctctccccgccggcccgcgggctcgccgtccggcgcagggcaggactgtctacaagagagaagctccccacgtggttccgtgtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatcagttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctca

SEQ ID NO: 167168 - DNA, 1278 bp, Homo sapiens
  Payload ID: 12899
  Gene Symbol: PCBP3
  Gene Name: poly(rC) binding protein 3
  ENST ID: ENST00000449640
  CDS Start-End: 193-1278
cttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggtaagagccgatccgctcgcggcctccactgccaacctcagccttttactgcagcacccgccgctgcccgcctacacaatccagggacagtatgccatccctcacccggatttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaa

SEQ ID NO: 167169 - DNA, 243 bp, Homo sapiens
  Payload ID: 12899
  Gene Symbol: PCBP3
  Gene Name: poly(rC) binding protein 3
  ENST ID: ENST00000549265
  CDS Start-End: 228-243
ctctacttcagcccttcatttcctggtagccactgagctgccccatggacactgggcagatggccagtgttagctgggaaggacagcagcagccgcagaggtggcagcaaggccagggcactttgcagacggcatggacgggtgacgccttctgggccccatctgtccttcctcacagcaccctcagcaccttaagccaccaccctcagccacaatttggcagaaggatggagtccaaggtct

SEQ ID NO: 167170 - DNA, 1964 bp, Homo sapiens
  Payload ID: 12900
  Gene Symbol: PCBP4
  Gene Name: poly(rC) binding protein 4
  Uniprot ID: P57723
  ENST ID: ENST00000322099
  CDS Start-End: 148-1359
cctctggagtccctgtggcagaactcaaatggaaggaggagcagctgcacccaggggagcagggtgtcacctccgttggatagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 167171 - DNA, 2015 bp, Homo sapiens
  Payload ID: 12900
  Gene Symbol: PCBP4
  Gene Name: poly(rC) binding protein 4
  Uniprot ID: P57723
  ENST ID: ENST00000355852
  CDS Start-End: 197-1408
gtcaaacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccaggaa

SEQ ID NO: 167172 - DNA, 1281 bp, Homo sapiens
  Payload ID: 12900
  Gene Symbol: PCBP4
  Gene Name: poly(rC) binding protein 4
  ENST ID: ENST00000395014
  CDS Start-End: 148-1281
cctctggagtccctgtggcagaactcaaatggaaggaggagcagctgcacccaggggagcagggtgtcacctccgttggatagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgccacagctccccctggcctgctgggcacaccctatgccatctccctctccaacttcatcggcccaagcccatgcccttcttggctttaccacctgcttccccagggccgccgccgggctt

SEQ ID NO: 167173 - DNA, 1835 bp, Homo sapiens
  Payload ID: 12900
  Gene Symbol: PCBP4
  Gene Name: poly(rC) binding protein 4
  Uniprot ID: P57723
  ENST ID: ENST00000428823
  CDS Start-End: 148-1230
cctctggagtccctgtggcagaactcaaatggaaggaggagcagctgcacccaggggagcagggtgtcacctccgttggatagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 167174 - DNA, 2009 bp, Homo sapiens
  Payload ID: 12900
  Gene Symbol: PCBP4
  Gene Name: poly(rC) binding protein 4
  Uniprot ID: P57723
  ENST ID: ENST00000484633
  CDS Start-End: 324-1406
ctttgtccaccaggccagatggagaggaagggagattggattcccctccccacccacacatacccagctgatgtcactcgcagttgtgagcggccgcctctcccggggacaatgtgggactgagcggcccagccgccgtgccgccgccgccgccgccgcaggacagccccagcgagcctctggagtccctgtggcagaactcaaatggaaggaggagcagctgcacccaggggagcagggtgtcacctccgttggatagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgacca

SEQ ID NO: 167175 - DNA, 2147 bp, Homo sapiens
  Payload ID: 12900
  Gene Symbol: PCBP4
  Gene Name: poly(rC) binding protein 4
  Uniprot ID: P57723
  ENST ID: ENST00000461554
  CDS Start-End: 333-1544
attgttcgcagctgatgtcactcgcagttgtgagcggccgcctctcccggggacaatgtgggactgagcggcccagccgccgtgccgccgccgccgccgccgcaggacagccccagcgaggccatttccagcacatagaagagagattggaaaccaacgtgcagaactgccagtcccctgacacgctgtgccccacccactgcagcccagtgctgaatgaaccctgcccagaggtgtctgtagtgagcttctgccctagtgacttttgagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgacca

SEQ ID NO: 167176 - DNA, 559 bp, Homo sapiens
  Payload ID: 12900
  Gene Symbol: PCBP4
  Gene Name: poly(rC) binding protein 4
  ENST ID: ENST00000497653
  CDS Start-End: 240-559
tttgtccaccaggccagatggagaggaagggagattggattcccctccccacccacacatacccagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgt

SEQ ID NO: 167177 - DNA, 510 bp, Homo sapiens
  Payload ID: 12900
  Gene Symbol: PCBP4
  Gene Name: poly(rC) binding protein 4
  ENST ID: ENST00000490063
  CDS Start-End: 252-510
gaggaagggagattggattcccctccccacccacacatacccaggtgccaagagactcagctgtggggggaggtggagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggtcc

SEQ ID NO: 167178 - DNA, 2087 bp, Homo sapiens
  Payload ID: 12900
  Gene Symbol: PCBP4
  Gene Name: poly(rC) binding protein 4
  ENST ID: ENST00000471308
  CDS Start-End: 528-701
ctcattgttcgcagctgatgtcactcgcagttgtgagcggccgcctctcccggggacaatgtgggactgagcggcccagccgccgtgccgccgccgccgccgccgcaggacagccccagcgaggccatttccagcacatagaagagagattggaaaccaacgtgcagaactgccagtcccctgacacgctgtgccccacccactgcagcccagtgctgaatgaaccctgcccagaggtgtctgtagtgagcttctgccctagtgacttttggtaggtgggagtgtgcctcaattcccccctcaacccctgcctcaagcctttaccaggcagtggcaagacctgaccacacccgaggcctccctgccttcaaggcttcccatggctgctccagcttcctccccagctgctcttctgtgctccatccaccatctggctgctggacgaaagtgcctctcatatggaagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgacc

SEQ ID NO: 167179 - DNA, 1784 bp, Homo sapiens
  Payload ID: 12900
  Gene Symbol: PCBP4
  Gene Name: poly(rC) binding protein 4
  ENST ID: ENST00000471622
  CDS Start-End: 204-1175
agcacatagaagagagattggaaaccaacgtgcagaactgccagtcccctgacacgctgtgccccacccactgcagcccagtgctgaatgaaccctgcccagaggtgtctgtagtgagcttctgccctagtgacttttgagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttt

SEQ ID NO: 167180 - DNA, 563 bp, Homo sapiens
  Payload ID: 12900
  Gene Symbol: PCBP4
  Gene Name: poly(rC) binding protein 4
  ENST ID: ENST00000483411
  CDS Start-End: 340-563
aaacccctcattgttcgcagctgatgtcactcgcagttgtgagcggccgcctctcccggggacaatgtgggactgagcggcccagccgccgtgccgccgccgccgccgccgcaggacagccccagcgagcctttaccaggcagtggcaagacctgaccacacccgaggcctccctgccttcaaggcttcccatggctgctccagcttcctccccagctgctcttctgtgctccatccaccatctggctgctggacgaaagtgcctctcatatggaagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgc

SEQ ID NO: 167181 - DNA, 837 bp, Homo sapiens
  Payload ID: 12900
  Gene Symbol: PCBP4
  Gene Name: poly(rC) binding protein 4
  ENST ID: ENST00000466412
  CDS Start-End: 464-837
agtaaaagactcaacggagcccgttccttgcgaccctatccccaaaaggaattccggggctgatgtcactcgcagttgtgagcggccgcctctcccggggacaatgtgggactgagcggcccagccgccgtgccgccgccgccgccgccgcaggacagccccagcgagcctctggagtccctgtggcagaactcaaatggaaggaggagcagctgcacccaggggagcagggtgtcacctccgttggataggccatttccagcacatagaagagagattggaaaccaacgtgcagaactgccagtcccctgacacgctgtgccccacccactgcagcccagtgctgaatgaaccctgcccagaggtgtctgtagtgagcttctgccctagtgacttttgagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaa

SEQ ID NO: 167182 - DNA, 562 bp, Homo sapiens
  Payload ID: 12900
  Gene Symbol: PCBP4
  Gene Name: poly(rC) binding protein 4
  ENST ID: ENST00000461544
  CDS Start-End: 425-562
aaacccctcattgttcgcagctgatgtcactcgcagttgtgagcggccgcctctcccggggacaatgtgggactgagcggcccagccgccgtgccgccgccgccgccgccgcaggacagccccagcgagcctctggagtccctgtggcagaactcaaatggaaggaggagcagctgcacccaggggagcagggtgtcacctccgttggataggccatttccagcacatagaagagagattggaaaccaacgtgcagaactgccagtcccctgacacgctgtgccccacccactgcagcccagtgctgaatgaaccctgcccagaggtgtctgtagtgagcttctgccctagtgacttttgagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcag

SEQ ID NO: 167183 - DNA, 704 bp, Homo sapiens
  Payload ID: 12900
  Gene Symbol: PCBP4
  Gene Name: poly(rC) binding protein 4
  ENST ID: ENST00000468324
  CDS Start-End: 200-704
caccaggccagatggagaggaagggagattggattcccctccccacccacacatacccagctgatgtcactcgcagttgtgagcggccgcctctcccggggacaatgtgggactgagcggcccagccgccgtgccgccgccgccgccgccgcaggacagccccagcgaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctg

SEQ ID NO: 167184 - DNA, 539 bp, Homo sapiens
  Payload ID: 12900
  Gene Symbol: PCBP4
  Gene Name: poly(rC) binding protein 4
  ENST ID: ENST00000489595
  CDS Start-End: 265-539
accgccagcacgcgcctgcttcccgtctgcgcgagtccacgcagctccccaggccatttccagcacatagaagagagattggaaaccaacgtgcagaactgccagtcccctgacacgctgtgccccacccactgcagcccagtgctgaatgaaccctgcccagaggtgtctgtagtgagcttctgccctagtgacttttgagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgc

SEQ ID NO: 167185 - DNA, 3527 bp, Homo sapiens
  Payload ID: 12901
  Gene Symbol: PMFBP1
  Gene Name: polyamine modulated factor 1 binding protein 1
  Uniprot ID: Q8TBY8
  ENST ID: ENST00000237353
  CDS Start-End: 263-3286
atttccatgatgcacctctgtgcatgaagacttcagagggtactcaatgcaggaaatcagaattcagctccataaaacattccagattccacatatcaccaacattctttcttcctcttggcttatattagggataggggatgtggtttgttacaaaggatgagtattttgatagcttctcattccttgaactattctgcaggtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctctccgccagtatcagtccatcctagagaagcagacttccgacctggttcttctgcaccatcactgcaaactgaaagaagatgaggtgattctctatgaggaggaaatgggaaatcacaacgagaacacaggggagaagctccatttggcgcaggagcaactcgccttggccggggacaagatcgcctctctagagaggagcttaaacctctacagggataaataccagtcttccctgagcaacatcgagttactagaatgccaagtgaagatgttgcagggggaactcggcgggatcatgggtcaggagcctgagaacaagggtgatcattcaaaggtacggatatacacttctccttgcatgattcaagagcatcaggagactcagaaacgactgtctgaagtctggcaaaaggtctctcaacaggatgatctcattcaagaacttcgaaataagctggcctgcagtaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctgctcagcaagcagcccagtgcaaagaagaggctgcactggcaggctgtcacctggaggacacccagaggaaactgcagaagggtctcctcctggacaagcagaaggcagacaccatccaggaactacagagagaacttcagatgctgcagaaggagtcctcgatggctgagaaggaacaaacctccaacagaaaacgggtggaggagctgtcattagaactctctgaagccctgaggaagcttgaaaattcagacaaggaaaagaggcagcttcagaagacagtggctgagcaggatatgaaaatgaatgacatgcttgatcgtatcaagcaccagcacagggagcaaggctccatcaaatgcaagttagaagaagatcttcaggaggccacaaagcttctggaggacaaacgggagcagttgaagaagagcaaagagcatgagaagctgatggagggagaacttgaagctttgcggcaggaatttaaaaagaaagacaagacgttgaaagagaattccagaaagttggaggaagaaaatgagaatctccgagcagagctacagtgttgttctacacaactggaatcctctctcaacaaatacaacaccagccagcaagtcatccaagacttgaataaagagatagcccttcagaaggagtccttaatgagcctgcaggcccagctggacaaagctctgcagaaggagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgacaagaagctagaggagatgagctgccaggtgctgcagtggcagaagcaacaccagaatgacctcaagatgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaaatacattgccaagctgagtggcgaaaaggaccacctccacagtgtaatggtccacttgcagcaggaaaacaagaagctgaagaaggagatagaagagaagaagatgaaagccgagaacacaaggctatgcaccaaagccctaggcccgagcagaacggagtccacacagagggagaaagtgtgcggcaccttgggctggaaggggttgccccaggatatgggtcaaagaatggacctcaccaagtacatcgggatgccccactgcccgggttcctcatactgctagaatccacatctagccctgagcagcatttccacgggtgtttcttcagaggacagtgagttcccagccctccctctctcttgacctggatcagctcttacaggagtatatcacggtcccagcctattttgcaagacactaacttttgttgagttttgtccacttcctgccatggagtgagctttagaaccatactaccatctccaggcccaaactctgaaataaagacatgagcatgagcaca

SEQ ID NO: 167186 - DNA, 3501 bp, Homo sapiens
  Payload ID: 12901
  Gene Symbol: PMFBP1
  Gene Name: polyamine modulated factor 1 binding protein 1
  Uniprot ID: Q8TBY8
  ENST ID: ENST00000355636
  CDS Start-End: 615-3263
caggtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacctcattgccctgaaaatatcagatcatagtgatacaaggggagcagcgtctgctatggatctcagacaaacttctaagtcaaccatgaaaataaaaaccatcacacctgctctaaggacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctctccgccagtatcagtccatcctagagaagcagacttccgacctggttcttctgcaccatcactgcaaactgaaagaagatgaggtgattctctatgaggaggaaatgggaaatcacaacgagaacacaggggagaagctccatttggcgcaggagcaactcgccttggccggggacaagatcgcctctctagagaggagcttaaacctctacagggataaataccagtcttccctgagcaacatcgagttactagaatgccaagtgaagatgttgcagggggaactcggcgggatcatgggtcaggagcctgagaacaagggtgatcattcaaaggtacggatatacacttctccttgcatgattcaagagcatcaggagactcagaaacgactgtctgaagtctggcaaaaggtctctcaacaggatgatctcattcaagaacttcgaaataagctggcctgcagtaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctgctcagcaagcagcccagtgcaaagaagaggctgcactggcaggctgtcacctggaggacacccagaggaaactgcagaagggtctcctcctggacaagcagaaggcagacaccatccaggaactacagagagaacttcagatgctgcagaaggagtcctcgatggctgagaaggaacaaacctccaacagaaaacgggtggaggagctgtcattagaactctctgaagccctgaggaagcttgaaaattcagacaaggaaaagaggcagcttcagaagacagtggctgagcaggatatgaaaatgaatgacatgcttgatcgtatcaagcaccagcacagggagcaaggctccatcaaatgcaagttagaagaagatcttcaggaggccacaaagcttctggaggacaaacgggagcagttgaagaagagcaaagagcatgagaagctgatggagggagaacttgaagctttgcggcaggaatttaaaaagaaagacaagacgttgaaagagaattccagaaagttggaggaagaaaatgagaatctccgagcagagctacagtgttgttctacacaactggaatcctctctcaacaaatacaacaccagccagcaagtcatccaagacttgaataaagagatagcccttcagaaggagtccttaatgagcctgcaggcccagctggacaaagctctgcagaaggagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgacaagaagctagaggagatgagctgccaggtgctgcagtggcagaagcaacaccagaatgacctcaagatgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaaatacattgccaagctgagtggcgaaaaggacagggaaccaaccagagccagcagccccaacacaacccgtccttcctctccttcccacagccacctccacagtgtaatggtccacttgcagcaggaaaacaagaagctgaagaaggagatagaagagaagaagatgaaagccgagaacacaaggctatgcaccaaagccctaggcccgagcagaacggagtccacacagagggagaaagtgtgcggcaccttgggctggaaggggttgccccaggatatgggtcaaagaatggacctcaccaagtacatcgggatgccccactgcccgggttcctcatactgctagaatccacatctagccctgagcagcatttccacgggtgtttcttcagaggacagtgagttcccagccctccctctctcttgacctggatcagctcttacaggagtatatcacggtcccagcctattttgcaagacactaacttttgttgagttttgtccacttcctgccatggagtgagctttagaaccatactaccatctccaggcccaaactctgaaataaagacatgagcatgagc

SEQ ID NO: 167187 - DNA, 3671 bp, Homo sapiens
  Payload ID: 12901
  Gene Symbol: PMFBP1
  Gene Name: polyamine modulated factor 1 binding protein 1
  ENST ID: ENST00000379073
  CDS Start-End: 235-540
aatagaagttcaccagctgaggactacgaggatattgaggacaatgtggagcagagccccagctgactcataaaggacatgtagcatgagtaaaaaataaaccttcacggtcgtaagccactgagacttgggggttgtttgttactacaccatcacctagcctgtccccaccaggtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacctcattgccctgaaaatatcagatcatagtgatacaaggggagcagcgtctgctatggatctcagacaaacttctaagtcaaccatgaaaataaaaaccatcacacctgctctaaggacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctctccgccagtatcagtccatcctagagaagcagacttccgacctggttcttctgcaccatcactgcaaactgaaagaagatgaggtgattctctatgaggaggaaatgggaaatcacaacgagaacacaggggagaagctccatttggcgcaggagcaactcgccttggccggggacaagatcgcctctctagagaggagcttaaacctctacagggataaataccagtcttccctgagcaacatcgagttactagaatgccaagtgaagatgttgcagggggaactcggcgggatcatgggtcaggagcctgagaacaagggtgatcattcaaaggtacggatatacacttctccttgcatgattcaagagcatcaggagactcagaaacgactgtctgaagtctggcaaaaggtctctcaacaggatgatctcattcaagaacttcgaaataagctggcctgcagtaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctgctcagcaagcagcccagtgcaaagaagaggctgcactggcaggctgtcacctggaggacacccagaggaaactgcagaagggtctcctcctggacaagcagaaggcagacaccatccaggaactacagagagaacttcagatgctgcagaaggagtcctcgatggctgagaaggaacaaacctccaacagaaaacgggtggaggagctgtcattagaactctctgaagccctgaggaagcttgaaaattcagacaaggaaaagaggcagcttcagaagacagtggctgagcaggatatgaaaatgaatgacatgcttgatcgtatcaagcaccagcacagggagcaaggctccatcaaatgcaagttagaagaagatcttcaggaggccacaaagcttctggaggacaaacgggagcagttgaagaagagcaaagagcatgagaagctgatggagggagaacttgaagctttgcggcaggaatttaaaaagaaagacaagacgttgaaagagaattccagaaagttggaggaagaaaatgagaatctccgagcagagctacagtgttgttctacacaactggaatcctctctcaacaaatacaacaccagccagcaagtcatccaagacttgaataaagagatagcccttcagaaggagtccttaatgagcctgcaggcccagctggacaaagctctgcagaaggagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgacaagaagctagaggagatgagctgccaggtgctgcagtggcagaagcaacaccagaatgacctcaagatgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaaatacattgccaagctgagtggcgaaaaggacagggaaccaaccagagccagcagccccaacacaacccgtccttcctctccttcccacagccacctccacagtgtaatggtccacttgcagcaggaaaacaagaagctgaagaaggagatagaagagaagaagatgaaagccgagaacacaaggctatgcaccaaagccctaggcccgagcagaacggagtccacacagagggagaaagtgtgcggcaccttgggctggaaggggttgccccaggatatgggtcaaagaatggacctcaccaagtacatcgggatgccccactgcccgggttcctcatactgctagaatccacatctagccctgagcagcatttccacgggtgtttcttcagaggacagtgagttcccagccctccctctctcttgacctggatcagctcttacaggagtatatcacggtcccagcctattttgcaagacactaacttttgttgagttttgtccacttcctgccatggagtgagctttagaaccatactaccatctccaggcccaaactctgaaataaagacatgagcatgag

SEQ ID NO: 167188 - DNA, 2038 bp, Homo sapiens
  Payload ID: 12901
  Gene Symbol: PMFBP1
  Gene Name: polyamine modulated factor 1 binding protein 1
  ENST ID: ENST00000537392
  CDS Start-End: 1-1509
caagtgaagatgttgcagggggaactcggcgggatcatgggtcaggagcctgagaacaagggtgatcattcaaaggtacggatatacacttctccttgcatgattcaagagcatcaggagactcagaaacgactgtctgaagtctggcaaaaggtctctcaacaggatgatctcattcaagaacttcgaaataagctggcctgcagtaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctgctcagcaagcagcccagtgcaaagaagaggctgcactggcaggctgtcacctggaggacacccagaggaaactgcagaagggtctcctcctggacaagcagaaggcagacaccatccaggaactacagagagaacttcagatgctgcagaaggagtcctcgatggctgagaaggaacaaacctccaacagaaaacgggtggaggagctgtcattagaactctctgaagccctgaggaagcttgaaaattcagacaaggaaaagaggcagcttcagaagacagtggctgagcaggatatgaaaatgaatgacatgcttgatcgtatcaagcaccagcacagggagcaaggctccatcaaatgcaagttagaagaagatcttcaggaggccacaaagcttctggaggacaaacgggagcagttgaagaagagcaaagagcatgagaagctgatggagggagaacttgaagctttgcggcaggaatttaaaaagaaagacaagacgttgaaagagaattccagaaagttggaggaagaaaatgagaatctccgagcagagctacagtgttgttctacacaactggaatcctctctcaacaaatacaacaccagccagcaagtcatccaagacttgaataaagagaaatgcagctaactgctcagccaactgcggatcctgggccacctacagctctacttccctccccattggcacctggttgctgagccagagaaatgtttcttccatatgtggaaggtctcatctcatatctggtggagccccaagctatttgggctttggcatcaagtcttccaatgttacattttagaccagaatagcccttcagaaggagtccttaatgagcctgcaggcccagctggacaaagctctgcagaaggagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgac

SEQ ID NO: 167189 - DNA, 458 bp, Homo sapiens
  Payload ID: 12901
  Gene Symbol: PMFBP1
  Gene Name: polyamine modulated factor 1 binding protein 1
  ENST ID: ENST00000536211
  CDS Start-End: 255-458
caacaggcaacatactagataatagaagttcaccagctgaggactacgaggatattgaggacaatgtggagcagagccccagctgactcataaaggacatgtagcatgagtaaaaaataaaccttcacggtcgtaagccactgagacttgggggttgtttgttactacaccatcacctagcctgtccccaccaggtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtca

SEQ ID NO: 167190 - DNA, 407 bp, Homo sapiens
  Payload ID: 12901
  Gene Symbol: PMFBP1
  Gene Name: polyamine modulated factor 1 binding protein 1
  ENST ID: ENST00000540440
  CDS Start-End: 265-407
tgaaacaggggttccaaaatgtagagtataagcaactagtggaggtgctagaaacggcacagctgtcaccaagagaagtcctactttgaaaagcagatggcaggagttttgaatacaaaaaaggagttgcctgggcagatggcagtagacaaggcatgaagaaatgaaggtctcaacagagacgcaagaggcagaacagaatatgtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatgga

SEQ ID NO: 167191 - DNA, 556 bp, Homo sapiens
  Payload ID: 12901
  Gene Symbol: PMFBP1
  Gene Name: polyamine modulated factor 1 binding protein 1
  ENST ID: ENST00000539172
  CDS Start-End: 226-556
agctagataagtctcagcacttcacatgtttcctaactttatgagcatcaacattatggcaagctgatgcttcaaaaacaccatatcatcagatatttcatatgaatagttacaaaattaatggaagctcctcatagagtagtaagagagcctctgtgaccctgggtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctc

SEQ ID NO: 167192 - DNA, 955 bp, Homo sapiens
  Payload ID: 12901
  Gene Symbol: PMFBP1
  Gene Name: polyamine modulated factor 1 binding protein 1
  ENST ID: ENST00000537792
  CDS Start-End: 1-351
atgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaaatacattgccaagctgagtggcgaaaaggagtcttttttgctgctttacacaaggattaaaaaagacagccacagccaagtcacgcatacaccaagtgtcctgggccagttttagatgcgatgggtccagccacctcccgctgccccggcagcacctcggatactctgcagccccgctcccgccatgccgtgctcctgcatggaagaactccacctcctctgccagagagtctggtccagcaggaactgccctggggggccgtgatatgcacagatgaaagtcctcagatgaaagggctttgtccgcagcctcagggctcccgccagaaggctgaggacccaatacctgctgccatcctctctggggacagcctcagctcacagaccaaagcgggctggcgtgcggcgaggggtcatgggctccccttgctctttccggcctggagtgtagatcttcgtagacctggagacacagcaggagagatcaggaaacaccgtgccctcacccacagccaggagggcaggaggatgcagagccccaggacttactgttcctaacccatggtggggagctctgggccgagggatctcctccccggcacattctcactcctctgccgtccccatgttcgactggcgatgtaatcaaggaagctcactcattccgatatgctttagatcggattttaacaactcctcccacagtccctaggggagct

SEQ ID NO: 167193 - DNA, 3935 bp, Homo sapiens
  Payload ID: 12901
  Gene Symbol: PMFBP1
  Gene Name: polyamine modulated factor 1 binding protein 1
  ENST ID: ENST00000537465
  CDS Start-End: 160-3228
attctttcttcctcttggcttatattagggataggggatgtggtttgttacaaaggatgagtattttgatagcttctcattccttgaactattctgcaggtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctctccgccagtatcagtccatcctagagaagcagacttccgacctggttcttctgcaccatcactgcaaactgaaagaagatgaggtgattctctatgaggaggaaatgggaaatcacaacgagaacacaggggagaagctccatttggcgcaggagcaactcgccttggccggggacaagatcgcctctctagagaggagcttaaacctctacagggataaataccagtcttccctgagcaacatcgagttactagaatgccaagtgaagatgttgcagggggaactcggcgggatcatgggtcaggagcctgagaacaagggtgatcattcaaaggtacggatatacacttctccttgcatgattcaagagcatcaggagactcagaaacgactgtctgaagtctggcaaaaggtctctcaacaggatgatctcattcaagaacttcgaaataagctggcctgcagtaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctggtgaggcccctgcagctcagcaagcagcccagtgcaaagaagaggctgcactggcaggctgtcacctggaggacacccagaggaaactgcagaagggtctcctcctggacaagcagaaggcagacaccatccaggaactacagagagaacttcagatgctgcagaaggagtcctcgatggctgagaaggaacaaacctccaacagaaaacgggtggaggagctgtcattagaactctctgaagccctgaggaagcttgaaaattcagacaaggaaaagaggcagcttcagaagacagtggctgagcaggatatgaaaatgaatgacatgcttgatcgtatcaagcaccagcacagggagcaaggctccatcaaatgcaagttagaagaagatcttcaggaggccacaaagcttctggaggacaaacgggagcagttgaagaagagcaaagagcatgagaagctgatggagggagaacttgaagctttgcggcaggaatttaaaaagaaagacaagacgttgaaagagaattccagaaagttggaggaagaaaatgagaatctccgagcagagctacagtgttgttctacacaactggaatcctctctcaacaaatacaacaccagccagcaagtcatccaagacttgaataaagagatagcccttcagaaggagtccttaatgagcctgcaggcccagctggacaaagctctgcagaaggagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgacaagaagctagaggagatgagctgccaggtgctgcagtggcagaagcaacaccagaatgacctcaagatgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaaatacattgccaagctgagtggcgaaaaggaccacctccacagtgtaatggtccacttgcagcaggaaaacaagaagctgaagaaggagatagaagagaagaagatgaaagccgagaacacaaggctatgcaccaaagccctaggcccgagcagaacggagtccacacagagggagaaagtgtgcggcaccttgggctggaaggggttgccccaggatatgggtcaaagaatggacctcaccaagtacatcgggatgccccactgcccgggtacgtctgccatttgtcaaaaaaataagtgtgatttttttctttaaatcactggattgagaattcaagtaggaagaagaaaataggccttttgtggcctcaagtcattttcttagcgactttggaccaaagatcgttgttttcacatctgtaaagggaggaggcaaattaagaccccttctgatctaagaacatctgaagcatacccaagtgcctcacatctcagacctgccccctcccctgacccagacccattttagggaacaggtagaagaggcatcttccttctacgtctggaaaccccgtaagagcaccccagccacctacccagcctgggtccacagccgcctttcctgccacctgtaaactccatgttaccccagaggcaagaagtcaccctgcagcagagctgcctggccatgcggccagcccttgaggaatcacctcgttaatttctcctcgaatcaaaactctcatttcctccctgttccctcaggttcctcatactgctagaatccacatctagccctgagcagcatttccacgggtgtttcttcagaggacagtgagttcccagccctccctctctcttgacctggatcagctcttacaggagtatatcacggtcccagcctattttgcaagacactaacttttgttgagttttgtccacttcctgccatggagtgagctttagaaccatactaccatctccaggcccaaactctgaaataaagacatgagcatgagcaca

SEQ ID NO: 167194 - DNA, 559 bp, Homo sapiens
  Payload ID: 12901
  Gene Symbol: PMFBP1
  Gene Name: polyamine modulated factor 1 binding protein 1
  ENST ID: ENST00000535461
  CDS Start-End: 90-559
aacacccttttaaaaacacaaacagatgggtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctctccgccagtatcagtccatcctagagaagcagacttccgacctggttcttctgcaccatcactgcaaactgaaagaagatgaggtgattctctatgaggaggaaatgggaaatcacaacgagaacacaggggagaagct

SEQ ID NO: 167195 - DNA, 1858 bp, Homo sapiens
  Payload ID: 12902
  Gene Symbol: PAOX
  Gene Name: polyamine oxidase (exo-N4-amino)
  Uniprot ID: Q6QHF9
  ENST ID: ENST00000278060
  CDS Start-End: 84-1619
ccccctcgctccgcctccggcctcctccgagagctccagacctcccggctactcagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcatggacctggtggccctggcaccctttggggagtataccgtgctgccggggctggactgcaccttttctaagggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggttttcttagggaacatttggacaccttctttgaccctcccctgccggctgagaaggcagaagcaatcaggaagataggctttgggaccaacaacaaaatcttcctggagtttgaggagcccttctgggagccagactgccagctgatccagctggtgtgggaggacacgtcgcccctggaggatgctgcccctgagctacaggacgcctggttccggaagctcattggctttgtggtcctgcctgcctttgcgtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggccagggttgacttgagctgagacaccagatgctcacggagatgctggacacataaagcaagttacagccaca

SEQ ID NO: 167196 - DNA, 1482 bp, Homo sapiens
  Payload ID: 12902
  Gene Symbol: PAOX
  Gene Name: polyamine oxidase (exo-N4-amino)
  Uniprot ID: Q6QHF9
  ENST ID: ENST00000356306
  CDS Start-End: 31-1008
cagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcatggacctggtggccctggcaccctttggggagtataccgtgctgccggggctggactgcaccttttctaagggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggcc

SEQ ID NO: 167197 - DNA, 1633 bp, Homo sapiens
  Payload ID: 12902
  Gene Symbol: PAOX
  Gene Name: polyamine oxidase (exo-N4-amino)
  Uniprot ID: Q6QHF9
  ENST ID: ENST00000357296
  CDS Start-End: 57-1517
cgagagctccagacctcccggctactcagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcatggacctggtggccctggcaccctttggggagtataccgtgctgccggggctggactgcaccttttctaagggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggttttcttagggaacatttggacaccttctttgaccctcccctgccggctgagaaggcagaagcaatcaggaagataggctttgggaccaacaacaaaatcttcctggagtttgaggagcccttctgggagccagactgccagctgatccagctggtgtgggaggacacgtcgcccctggaggatgctgcccctgagctacaggacgcctggttccggaagctcattggctttgtggtcctgcctgcctttgcgtctgtccacgttctctgtgggttcattgccggacttgagtctgagttcatggagactctgtcggatgaagaagtacttctgtgtctcacccaagtgctccggagagtgacagctccagatcctgtttgcgggggaagccacacatcgcacgttttactccacgacgcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggccagggttgacttgagctgagacaccagatgc

SEQ ID NO: 167198 - DNA, 609 bp, Homo sapiens
  Payload ID: 12902
  Gene Symbol: PAOX
  Gene Name: polyamine oxidase (exo-N4-amino)
  ENST ID: ENST00000368539
  CDS Start-End: 142-480
ctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggcc

SEQ ID NO: 167199 - DNA, 837 bp, Homo sapiens
  Payload ID: 12902
  Gene Symbol: PAOX
  Gene Name: polyamine oxidase (exo-N4-amino)
  Uniprot ID: Q6QHF9
  ENST ID: ENST00000529585
  CDS Start-End: 31-240
cagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggtctgtccacgttctctgtgggttcattgccggacttgagtctgagttcatggagactctgtcggatgaagaagtacttctgtgtctcacccaagtgctccggagagtgacagctccagatcctgtttgcgggggaagccacacatcgcacgttttactccacgacgcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggcc

SEQ ID NO: 167200 - DNA, 1336 bp, Homo sapiens
  Payload ID: 12902
  Gene Symbol: PAOX
  Gene Name: polyamine oxidase (exo-N4-amino)
  Uniprot ID: Q6QHF9
  ENST ID: ENST00000476834
  CDS Start-End: 31-240
cagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttagaacttgtcagtgtttccaaatcagcacacatagatctacagcggtcttttttgtttccctccagtggctttgttcattcacgtttggagttttcttagggaacatttggacaccttctttgaccctcccctgccggctgagaaggcagaagcaatcaggaagataggctttgggaccaacaacaaaatcttcctggagtttgaggagcccttctgggagccagactgccagctgatccagctggtgtgggaggacacgtcgcccctggaggatgctgcccctgagctacaggacgcctggttccggaagctcattggctttgtggtcctgcctgcctttgcgtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggcc

SEQ ID NO: 167201 - DNA, 995 bp, Homo sapiens
  Payload ID: 12902
  Gene Symbol: PAOX
  Gene Name: polyamine oxidase (exo-N4-amino)
  Uniprot ID: Q6QHF9
  ENST ID: ENST00000483211
  CDS Start-End: 31-240
cagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggcc

SEQ ID NO: 167202 - DNA, 1324 bp, Homo sapiens
  Payload ID: 12902
  Gene Symbol: PAOX
  Gene Name: polyamine oxidase (exo-N4-amino)
  Uniprot ID: Q6QHF9
  ENST ID: ENST00000480071
  CDS Start-End: 31-1008
cagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcatggacctggtggccctggcaccctttggggagtataccgtgctgccggggctggactgcaccttttctaagggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggtctgtccacgttctctgtgggttcattgccggacttgagtctgagttcatggagactctgtcggatgaagaagtacttctgtgtctcacccaagtgctccggagagtgacagctccagatcctgtttgcgggggaagccacacatcgcacgttttactccacgacgcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggcc

SEQ ID NO: 167203 - DNA, 884 bp, Homo sapiens
  Payload ID: 12903
  Gene Symbol: PMF1
  Gene Name: polyamine-modulated factor 1
  Uniprot ID: Q6P1K2
  ENST ID: ENST00000368273
  CDS Start-End: 11-634
caacttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctctccactccttcattgggacggaagtgctggtccccgcctgccctctggtggacagtctgtgaaacaggccttcagttgggcggcgtgcaggttaccacaggggaggaaggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgt

SEQ ID NO: 167204 - DNA, 1068 bp, Homo sapiens
  Payload ID: 12903
  Gene Symbol: PMF1
  Gene Name: polyamine-modulated factor 1
  Uniprot ID: Q6P1K2
  ENST ID: ENST00000368277
  CDS Start-End: 10-627
aacttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgtaa

SEQ ID NO: 167205 - DNA, 1019 bp, Homo sapiens
  Payload ID: 12903
  Gene Symbol: PMF1
  Gene Name: polyamine-modulated factor 1
  Uniprot ID: Q6P1K2
  ENST ID: ENST00000368279
  CDS Start-End: 24-566
agatttggaggttcaacttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctgcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgt

SEQ ID NO: 167206 - DNA, 837 bp, Homo sapiens
  Payload ID: 12903
  Gene Symbol: PMF1
  Gene Name: polyamine-modulated factor 1
  ENST ID: ENST00000497069
  CDS Start-End: 1-281
caagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctctccactccttcattgggacggaagtgctggtccccgcctgccctctggtggacagtctgtgaaacaggccttcagttgggcggcgtgcaggttaccacaggggaggaagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagca

SEQ ID NO: 167207 - DNA, 933 bp, Homo sapiens
  Payload ID: 12903
  Gene Symbol: PMF1
  Gene Name: polyamine-modulated factor 1
  ENST ID: ENST00000466489
  CDS Start-End: 12-275
tcaacttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagacggagtttcactcttgttgcccagactggagtgcagtggcgtgatctcggctcatggcaacctccacctcctgggttcaagcaattctcctcagcctcctgagtagccgggattataggtgccgccaccacgcccagctaatttttgtatttttagtagagatggggtttcaccatgttagccaggctgatctcgaactcctaatgtcagtcccttttctagctcctccggtcatgatacatccacactccagactctgtgtctggccctgcatggaagccaacatggccagatggcctggattgagtcccagctggctccatcacatgctggttgtgtgaccttgggcaagcttctctctgcctcagcttcctcatctgaaaaatgggggtgatgataatagaaccccgcctcacagaatcatggttgatctgcagtccctttgacggcaggaattgtactgtttcgtctttgggtttgtaccaccaagcttggcctggtacctggtcggtgctcactctccactccttcattgggacggaagtgctggtccccgcctgccctctggtggacagtctgtgaaacaggccttcagttgggcggcgtgcaggttaccacaggggaggaagctaccagagattcactgactgctataagtgcttctaccagttgcagcctgcgatgacacagcaaatctatgacaagtttatagctcagttgcagacatctatccgggaggaaatctctgacatcaaagagg

SEQ ID NO: 167208 - DNA, 5145 bp, Homo sapiens
  Payload ID: 12904
  Gene Symbol: PBRM1
  Gene Name: polybromo 1
  Uniprot ID: Q86U86
  ENST ID: ENST00000296302
  CDS Start-End: 3-5072
ccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaagagcgggcagctaaagttgctgagcagcaggagagagagcgagcagcacagcaacagcagccgagtgcttctccccgagcaggcacccctgtgggggctctcatgggggtggtgccaccaccaacaccaatggggatgctcaatcagcagttgacacctgttgcaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggt

SEQ ID NO: 167209 - DNA, 4825 bp, Homo sapiens
  Payload ID: 12904
  Gene Symbol: PBRM1
  Gene Name: polybromo 1
  Uniprot ID: Q86U86
  ENST ID: ENST00000337303
  CDS Start-End: 4-4752
tccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggt

SEQ ID NO: 167210 - DNA, 7523 bp, Homo sapiens
  Payload ID: 12904
  Gene Symbol: PBRM1
  Gene Name: polybromo 1
  Uniprot ID: Q86U86
  ENST ID: ENST00000356770
  CDS Start-End: 4-4812
tccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgagtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaataaatacagagtttgcaaagtgatttggattaaccagg

SEQ ID NO: 167211 - DNA, 5071 bp, Homo sapiens
  Payload ID: 12904
  Gene Symbol: PBRM1
  Gene Name: polybromo 1
  Uniprot ID: Q86U86
  ENST ID: ENST00000394830
  CDS Start-End: 101-4849
aggagcaatagcagcagccgtggcggccacggggcggggcgcggcggtcggtgaccgcggccggggctgcaggcggcggagcggctggaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctgaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcata

SEQ ID NO: 167212 - DNA, 4905 bp, Homo sapiens
  Payload ID: 12904
  Gene Symbol: PBRM1
  Gene Name: polybromo 1
  Uniprot ID: Q86U86
  ENST ID: ENST00000410007
  CDS Start-End: 4-4833
tccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctgaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactggggg

SEQ ID NO: 167213 - DNA, 4980 bp, Homo sapiens
  Payload ID: 12904
  Gene Symbol: PBRM1
  Gene Name: polybromo 1
  Uniprot ID: Q86U86
  ENST ID: ENST00000409057
  CDS Start-End: 4-4908
tccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactggggg

SEQ ID NO: 167214 - DNA, 4849 bp, Homo sapiens
  Payload ID: 12904
  Gene Symbol: PBRM1
  Gene Name: polybromo 1
  Uniprot ID: Q86U86
  ENST ID: ENST00000409767
  CDS Start-End: 4-4797
tccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaaggaacactcatgacagtgagatgttgggtctcaggaggctatccagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagta

SEQ ID NO: 167215 - DNA, 5015 bp, Homo sapiens
  Payload ID: 12904
  Gene Symbol: PBRM1
  Gene Name: polybromo 1
  Uniprot ID: Q86U86
  ENST ID: ENST00000409114
  CDS Start-End: 4-4962
tccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaaggaacactcatgacagtgagatgttgggtctcaggaggctatccagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaagagcgggcagctaaagttgctgagcagcaggagagagagcgagcagcacagcaacagcagccgagtgcttctccccgagcaggcacccctgtgggggctctcatgggggtggtgccaccaccaacaccaatggggatgctcaatcagcagttgacacctgttgcaggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtag

SEQ ID NO: 167216 - DNA, 4385 bp, Homo sapiens
  Payload ID: 12904
  Gene Symbol: PBRM1
  Gene Name: polybromo 1
  ENST ID: ENST00000423351
  CDS Start-End: 4-4385
tccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggg

SEQ ID NO: 167217 - DNA, 783 bp, Homo sapiens
  Payload ID: 12904
  Gene Symbol: PBRM1
  Gene Name: polybromo 1
  ENST ID: ENST00000420148
  CDS Start-End: 327-783
gactggttttgcggcggcaccgggaggggtaagggaggtgagggcggcgggtgccgaagcgacggcagcggccgcggccggaggagcaatagcagcagccgtggcggccacggggcggggcgcggcggtcggtgaccgcggccggggctgcaggcggcggagcggctggcttgccaacacttggtgtcacatgtgagcctcccacatgtattcactctccattccagctctgtgattgaactctgctcttattgactagggggcagttgggcaggcatgcctcattcctggaattgacagtcattcctaataagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttc

SEQ ID NO: 167218 - DNA, 457 bp, Homo sapiens
  Payload ID: 12904
  Gene Symbol: PBRM1
  Gene Name: polybromo 1
  ENST ID: ENST00000424867
  CDS Start-End: 380-457
ggcggtcggtgaccgcggccggggctgcaggcggcggagcggctgggtcgcccatatttgattttgagctccaaaatggaagattggaaaatatgttttgaagagcttgccaacacttggtgtcacatgtgagcctcccacatgtattcactctccattccagctctgtgattgaactctgctcttattgactagggggcagttgggcaggcatgcctcattcctggaattgacagtcattcctaatttttgaatatactaacactgaatcagcacttctaaagcccttccttctcccactggcttcacttggctttcagacataatgaggagactggcttttcgaggcgctggttgtgctctgaagaagttggattccatgggttccaagagaagaagagctacctccccttccagcagtgtcagcggggactttgatgatgggcaccattctgtg

SEQ ID NO: 167219 - DNA, 3256 bp, Homo sapiens
  Payload ID: 12904
  Gene Symbol: PBRM1
  Gene Name: polybromo 1
  ENST ID: ENST00000446103
  CDS Start-End: 1-3256
atccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaaggaacactcatgacagtgagatgttgggtctcaggaggctatccagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttgg

SEQ ID NO: 167220 - DNA, 4766 bp, Homo sapiens
  Payload ID: 12904
  Gene Symbol: PBRM1
  Gene Name: polybromo 1
  Uniprot ID: Q86U86
  ENST ID: ENST00000412587
  CDS Start-End: 4-2574
tccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcgctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggt

SEQ ID NO: 167221 - DNA, 547 bp, Homo sapiens
  Payload ID: 12904
  Gene Symbol: PBRM1
  Gene Name: polybromo 1
  ENST ID: ENST00000439181
  CDS Start-End: 418-547
tgggcccagtagccttgtcgcacctgccggcagggacaaaggcgcactacgggtcggaaactccccgcgctcctctttcccgctcgtcgcggggcagcttcaaagctgtcaacgtttccctcagtccccaataccagtgacagcttgccaacacttggtgtcacatgtgagcctcccacatgtattcactctccattccagctctgtgattgaactctgctcttattgactagggggcagttgggcaggcatgcctcattcctggaattgacagtcattcctaatttttgaatatactaacactgaatcagcacttctaaagcccttccttctcccactggcttcacttggctttcagacataatgaggagactggcttttcgaggcgctggttgtgctctgaagaagttggattccatgggttccaagagaagaagagctacctccccttccagcagtgtcagcggggactttgatgatgggcaccattctgtgtcaacaccaggcccaagcaggaaaaggaggagactttccaatcttccaactg

SEQ ID NO: 167222 - DNA, 809 bp, Homo sapiens
  Payload ID: 12904
  Gene Symbol: PBRM1
  Gene Name: polybromo 1
  ENST ID: ENST00000431678
  CDS Start-End: 118-809
gcggccgcggccggaggagcaatagcagcagccgtggcggccacggggcggggcgcggcggtcggtgaccgcggccggggctgcaggcggcggagcggctggaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaa

SEQ ID NO: 167223 - DNA, 476 bp, Homo sapiens
  Payload ID: 12904
  Gene Symbol: PBRM1
  Gene Name: polybromo 1
  ENST ID: ENST00000458294
  CDS Start-End: 348-476
aggtgagggcggcgggtgccgaagcgacggcagcggccgcggccggaggagcaatagcagcagccgtggcggccacggggcggggcgcggcggtcggtgaccgcggccggggctgcaggcggcggagcggctgggtcgcccatatttgattttgagctccaaaatggaagattggaaaatatgttttgaagagcttgccaacacttggtgtcacatgtgagcctcccacatgtattcactctccattccagctctgtgattgaactctgctcttattgactagggggcagttgggcaggcatgcctcattcctggaattgacagtcattcctaataagttggattccatgggttccaagagaagaagagctacctccccttccagcagtgtcagcggggactttgatgatgggcaccattctgtgtcaacaccaggcccaagcaggaaaaggaggagactttccaatcttccaact

SEQ ID NO: 167224 - DNA, 517 bp, Homo sapiens
  Payload ID: 12904
  Gene Symbol: PBRM1
  Gene Name: polybromo 1
  ENST ID: ENST00000449505
  CDS Start-End: 163-517
cggatgggcccagtagccttgtcgcacctgccggcagggacaaaggcgcactacgggtcggaaactccccgcgctcctctttcccgctcgtcgcggggcagcttcaaagctgtcaacgtttccctcagtccccaataccagtgacagaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttc

SEQ ID NO: 167225 - DNA, 517 bp, Homo sapiens
  Payload ID: 12904
  Gene Symbol: PBRM1
  Gene Name: polybromo 1
  ENST ID: ENST00000450271
  CDS Start-End: 257-517
gcggccgcggccggaggagcaatagcagcagccgtggcggccacggggcggggcgcggcggtcggtgaccgcggccggggctgcaggcggcggagcggctggcttgccaacacttggtgtcacatgtgagcctcccacatgtattcactctccattccagctctgtgattgaactctgctcttattgactagggggcagttgggcaggcatgcctcattcctggaattgacagtcattcctaataagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtg

SEQ ID NO: 167226 - DNA, 1792 bp, Homo sapiens
  Payload ID: 12905
  Gene Symbol: PCGF1
  Gene Name: polycomb group ring finger 1
  Uniprot ID: Q9BSM1
  ENST ID: ENST00000233630
  CDS Start-End: 913-1692
tgaggtctccattggaatctctcccttctcgtatctccagttgcatttgatgttaatacctcatagcaaatttatccctttttaagtacccagagccggcggtgtagagctctcgagcgagcaccccgcgtagtccccaagtgcgggactgggcctatgctactacaggcgctcgctgcctaagcctgtctgtgtgtggcagtgtcctagtcgtcctcccctcctccttcggcatctgctctgcattagtctgtcccaggcctccgcaggcgccgatgattaaatcatcatcattaaccagggcctgccccccccatccccggcagcaggggggagaatgggggaataagatcactaccaagtccctgggggtctctcactccccatcccccggcaccctctccgagactctgcaaagcccaagaaactccctccgtgaagccgggagaagacccgccatctggacgaagctccgctacgcggacgccgacagggcggcattacgaggagaggacccaggaggggcttcttcagcagggtcgtcgtcacagaagaccgacgaccctgagcgggtagcgggcacagactgccaggcctttgggggtaggagggggcagtctttcgcaggctccgaaagttagtcttgaggtcgcgtagggcctattatgatgatttctacaggaggttgaagagataagacccttccctgtgctcccccccccccactccttaattacggattgagcaggggaggggccggtggggctcaggtgagcacacagggagaaagggacgtgggcggggccttacagagggtgagcgaatccgaaaagacctagaacctcgttgctgggagacaagtcccgccctgcaggcggcaccggaagtggccggctgggatcagcctttaagatggcgtctcctcaggggggccagattgcgatcgcgatgaggcttcggaaccagctccagtcagtgtacaagatggacccgctacggaacgaggaggaggttcgagtgaagatcaaagacttgaatgaacacattgtttgctgcctatgcgccggctacttcgtggatgccaccaccatcacagagtgtcttcatactttctgcaagagttgtattgtgaagtacctccaaactagcaagtactgccccatgtgcaacattaagatccacgagacacagccactgctcaacctcaaactggaccgggtcatgcaggacatcgtgtataagctggtgcctggcttgcaagacagtgaagagaaacggattcgggaattctaccagtcccgaggtttggaccgggtcacccagcccactggggaagagccagcactgagcaacctcggcctccccttcagcagctttgaccactctaaagcccactactatcgctatgatgagcagttgaacctgtgcctggagcggctgagttctggcaaagacaagaataaaagcgtcctgcagaacaagtatgtccgatgttctgttagagctgaggtacgccatctccggagggtcctgtgtcaccgcttgatgctaaaccctcagcatgtgcagctcctttttgacaatgaagttctccctgatcacatgacaatgaagcagatatggctctcccgctggttcggcaagccatcccctttgcttttacaatacagtgtgaaagagaagaggaggtaggggccaagcccccaccccatcccactccccttccctccccagatatttatgtgaaatgaactgcagctttattttttgaaataaaaacttttaaaaagca

SEQ ID NO: 167227 - DNA, 988 bp, Homo sapiens
  Payload ID: 12905
  Gene Symbol: PCGF1
  Gene Name: polycomb group ring finger 1
  ENST ID: ENST00000612049
  CDS Start-End: 197-910
ggaaaggagggtcaggcgagtccacgtgagggaagcccccgctgtgcgcggagccctctgctgggcggagggggagtgccagcccccaggagctaatccccggctgatggcgcagggcgcggggcttggccgtctagtgtgatgaaggaggcgacccccaaggtgggaaggcgcacgggttggggtttgagggtggatgattggtgacggagggtgtatcttcgaggaggttcgagtgaagatcaaagacttgaatgaacacattgtttgctgcctatgcgccggctacttcgtggatgccaccaccatcacagagtgtcttcatactttctgcaagagttgtattgtgaagtacctccaaactagcaagtactgccccatgtgcaacattaagatccacgagacacagccactgctcaacctcaaactggaccgggtcatgcaggacatcgtgtataagctggtgcctggcttgcaagacagtgaagagaaacggattcgggaattctaccagtcccgaggtttggaccgggtcacccagcccactggggaagagccagcactgagcaacctcggcctccccttcagcagctttgaccactctaaagcccactactatcgctatgatgagcagttgaacctgtgcctggagcggctgagttctggcaaagacaagaataaaagcgtcctgcagaacaagtatgtccgatgttctgttagagctgaggtacgccatctccggagggtcctgtgtcaccgcttgatgctaaaccctcagcatgtgcagctcctttttgacaatgaagttctccctgatcacatgacaatgaagcagatatggctctcccgctggttcggcaagccatcccctttgcttttacaatacagtgtgaaagagaagaggaggtaggggccaagcccccaccccatcccactccccttccctccccagatatttatgtgaaatgaactgcagctttattttttg

SEQ ID NO: 167228 - DNA, 2604 bp, Homo sapiens
  Payload ID: 12906
  Gene Symbol: PCGF2
  Gene Name: polycomb group ring finger 2
  ENST ID: ENST00000610440
  CDS Start-End: 244-1278
tctcccctcccgccgcccgggcgagcgacacggctgcggcccccctcccctcccttccctccctccctcccatccccccctccccgagacccaccggaccccgaacccagatggccgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaatcgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctctttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttct

SEQ ID NO: 167229 - DNA, 2179 bp, Homo sapiens
  Payload ID: 12906
  Gene Symbol: PCGF2
  Gene Name: polycomb group ring finger 2
  Uniprot ID: P35227
  ENST ID: ENST00000611883
  CDS Start-End: 202-1236
gagagcccgaacaggaagagggtacagctttgtgcaggtcacatgcccactgcagccctccagcctctggtccccagagcggactttggaagctgaactgcttttgttgctggaagacttatgttataatttaccctgggtggaccagggtcgtacaaaagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaatcgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctctttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacag

SEQ ID NO: 167230 - DNA, 1499 bp, Homo sapiens
  Payload ID: 12906
  Gene Symbol: PCGF2
  Gene Name: polycomb group ring finger 2
  ENST ID: ENST00000618941
  CDS Start-End: 347-1120
ggactccccctgcctttccctctcctggcctgtaaccctctggggattgggatgggggccggccgttcttcgcaagccccgatgggagggggaggctctgagccgatcctgccttcgcaccccccgcgccccgtcagtccctagcccagcttgccccgtccgcctttctttctcccttttttctgtccctttttccctttcctctcttccaagatggccgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccaggcaaggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtgggg

SEQ ID NO: 167231 - DNA, 3062 bp, Homo sapiens
  Payload ID: 12906
  Gene Symbol: PCGF2
  Gene Name: polycomb group ring finger 2
  Uniprot ID: P35227
  ENST ID: ENST00000616199
  CDS Start-End: 703-1737
gtggctgcaggctcgagctggggtcactcggcggccagtgtgcgcaggtctcctggtcgccggccagagggcgaaagcattcacccgaggcccccagcttcgcggctgccttggctgcgagcaacgagggaagaggaggcaggcgctccaaaactgggcgaagattcctatcctaatttctaactcgagcctcccaccgtcagtgcgcttaatggcgctgctggccggatggataatcgagctctctggagggacagacgcggccgccatccctaataaatcgtgaataacgaatgagggaatcgaccatcctcatgaggcccacgggcgtccagtaacgcagtatcgattcgcttccccggcgtcggcctcaccgctactcccggcgtttccaagcctccctcctcgttctctccctcctgccggagccactgcggaccggagccccagcgccaggtttctcccctcccgccgcccgggcgagcgacacggctgcggcccccctcccctcccttccctccctccctcccatccccccctccccgagacccaccggaccccgaacccagatggccgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaatcgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctctttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttc

SEQ ID NO: 167232 - DNA, 2604 bp, Homo sapiens; identical to SEQ ID NO: 167228
  Payload ID: 12906
  Gene Symbol: PCGF2
  Gene Name: polycomb group ring finger 2
  Uniprot ID: P35227
  ENST ID: ENST00000620225
  CDS Start-End: 244-1278

SEQ ID NO: 167233 - DNA, 459 bp, Homo sapiens
  Payload ID: 12906
  Gene Symbol: PCGF2
  Gene Name: polycomb group ring finger 2
  ENST ID: ENST00000610747
  CDS Start-End: 1-200
ggcctctccccctcaagtaccgtgtccagccagcctgcaagcggctcaccctagccacggtgcccaccccctccgagggcaccaacaccagcggggcgtccgagtctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactt

SEQ ID NO: 167234 - DNA, 1534 bp, Homo sapiens
  Payload ID: 12906
  Gene Symbol: PCGF2
  Gene Name: polycomb group ring finger 2
  ENST ID: ENST00000616129
  CDS Start-End: 317-1090
ccctcggtcccctcccctcccctctccctcccaccccaagccgctttcacaaactcctttcttaccgtaggtttctcccctcccgccgcccgggcgagcgacacggctgcggcccccctcccctcccttccctccctccctcccatccccccctccccgagacccaccggaccccgaacccagatggccgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccaggcaaggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttatt

SEQ ID NO: 167235 - DNA, 1196 bp, Homo sapiens
  Payload ID: 12906
  Gene Symbol: PCGF2
  Gene Name: polycomb group ring finger 2
  ENST ID: ENST00000618506
  CDS Start-End: 209-820
ccctcccaccccaagccgctttcacaaactcctttcttaccgtaggtttctcccctcccgccgcccgggcgagcgacacggctgcggcccccctcccctcccttccctccctccctcccatccccccctccccgagacccaccggaccccgaacccagtctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccaggcaaggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtg

SEQ ID NO: 167236 - DNA, 459 bp, Homo sapiens; identical to SEQ ID NO: 167233
  Payload ID: 12906
  Gene Symbol: PCGF2
  Gene Name: polycomb group ring finger 2
  ENST ID: ENST00000632316
  CDS Start-End: 1-200

SEQ ID NO: 167237 - DNA, 1196 bp, Homo sapiens; identical to SEQ ID NO: 167235
  Payload ID: 12906
  Gene Symbol: PCGF2
  Gene Name: polycomb group ring finger 2
  ENST ID: ENST00000633865
  CDS Start-End: 209-820

SEQ ID NO: 167238 - DNA, 1499 bp, Homo sapiens; identical to SEQ ID NO: 167230
  Payload ID: 12906
  Gene Symbol: PCGF2
  Gene Name: polycomb group ring finger 2
  ENST ID: ENST00000632068
  CDS Start-End: 347-1120

SEQ ID NO: 167239 - DNA, 1534 bp, Homo sapiens; identical to SEQ ID NO: 167234
  Payload ID: 12906
  Gene Symbol: PCGF2
  Gene Name: polycomb group ring finger 2
  ENST ID: ENST00000632510
  CDS Start-End: 317-1090

SEQ ID NO: 167240 - DNA, 2179 bp, Homo sapiens; identical to SEQ ID NO: 167229
  Payload ID: 12906
  Gene Symbol: PCGF2
  Gene Name: polycomb group ring finger 2
  ENST ID: ENST00000631610
  CDS Start-End: 202-1236

SEQ ID NO: 167241 - DNA, 3062 bp, Homo sapiens; identical to SEQ ID NO: 167231
  Payload ID: 12906
  Gene Symbol: PCGF2
  Gene Name: polycomb group ring finger 2
  ENST ID: ENST00000631566
  CDS Start-End: 703-1737

SEQ ID NO: 167242 - DNA, 5685 bp, Homo sapiens
  Payload ID: 12907
  Gene Symbol: PCGF3
  Gene Name: polycomb group ring finger 3
  Uniprot ID: Q3KNV8
  ENST ID: ENST00000362003
  CDS Start-End: 396-1124
gcccagacgcacaccgcgcatgctccgagcgcggcgcccccgacgcggcgctcggctcggctcgggcatttccgcctctttgttttaaactccggacgggcttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcagggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccctgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagcttaagtgaaagtgtttctggctggaaatgtattacataaatcatttgtatgagcatgagagatgacttgctcatgggatgagcaatgctgtgggtattggatggaccactcaggcagcctggccgcacacacacacatgcatgctacatatgtgtacgctcagaccacatgcctgcacatatgtccacacaccagcccacggctcccttcctcaccccagccctccccactcccaggttaaccaatgtctcgatttgcttcaggcggcatttgtaaactgtcaccctgcttgcaaaccctcatttaaattggtccagcatttgctaccagagtttaggccacaaactttgtaaagctcagtttgtctccttgcagaaagaggttgctgcagtttggagctggttatgccaaggaaaatacggctaaaaaagaacttactgattcccataggtgtgtcaactgacaaatgaatgttccatctccctacgacaatttgctgcccctccccaaaaaaagcactatggccaaaatttcagtttttaaaggttaagtaaa

SEQ ID NO: 167243 - DNA, 1175 bp, Homo sapiens
  Payload ID: 12907
  Gene Symbol: PCGF3
  Gene Name: polycomb group ring finger 3
  ENST ID: ENST00000400151
  CDS Start-End: 377-898
atgctccgagcgcggcgcccccgacgcggcgctcggctcggctcgggcatttccgcctctttgttttaaactccggacgggcttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacacctgtacgtgccctgcccgcgccacccagggagggcgcgcccttcccagctctgtgctcttcagaaccttggcttttgtgttaccacacgcttttagctcaagcccgacaaaagcaggaaccaggaccaggggcagagacgatcttgaagataagtcagaaaagtcatttcacgctaaaggtcctgtgggtggtgtcagagcagatgaggcctcgcttaggagagcgaaacacaggagagaccccacattcctcccacggagcagcaaggccagtagccgctgtgacagtgctcactgctggcagtttccaaatctccagaggagttccttagatccttcaaaggggaaccttccagtgtgttcttcacacctgatgtgcgtcctcacacctgatgagtctgtgctttggtgttagaggactcacacctggggctggacctgagtgtttttctaagtgtggctaccgctgacgggcaggtgccatccatcaggctgaggctcggctcttatgctaacctgaggccccatggctggcggccctgctggtgtggacgaccgctgtgtgcgtctcttgatggctggggagcattttgtttaaacaggatctttaaaatgaagtgtacgcttataatacaagtgatgcttgtgtatttctcactttaggaaataaaatatttgccaatttgatagaa

SEQ ID NO: 167244 - DNA, 639 bp, Homo sapiens
  Payload ID: 12907
  Gene Symbol: PCGF3
  Gene Name: polycomb group ring finger 3
  ENST ID: ENST00000433814
  CDS Start-End: 313-639
agatgcgggcacaggagggagcttcccacactgttcaggtcaccagagcctgcgcttctgtggttggttttgatgaggactcgtatttcagctcctgtctctccttgtcagaggccgtgtgaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaag

SEQ ID NO: 167245 - DNA, 582 bp, Homo sapiens
  Payload ID: 12907
  Gene Symbol: PCGF3
  Gene Name: polycomb group ring finger 3
  ENST ID: ENST00000427463
  CDS Start-End: 395-582
atgctccgagcgcggcgcccccgacgcggcgctcggctcggctcgggcatttccgcctctttgttttaaactccggacgggcttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcaggtgccgtttctgtgctagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagcca

SEQ ID NO: 167246 - DNA, 2621 bp, Homo sapiens
  Payload ID: 12907
  Gene Symbol: PCGF3
  Gene Name: polycomb group ring finger 3
  ENST ID: ENST00000430644
  CDS Start-End: 329-673
atttccgcctctttgttttaaactccggacgggcttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacacctctcaagcccgacaaaagcaggaaccaggaccaggggcagagacgatcttgaagataagtcagaaaagtcatttcacgctaaaggtcctgtgggtggtgtcagagcagatgaggcctcgcttaggagagcgaaacacaggagagaccccacattcctcccacggagcagcaaggccagtagccgctgtgacagtgctcactgctggcagtttccaaatctccagaggagttccttagatccttcaaaggggaaccttccagtgtgttcttcacacctgatgtgcgtcctcacacctgatgagtctgtgctttggtgttagaggactcacacctggggctggacctgagtgtttttctaagtgtggctaccgctgacgggcaggtgccatccatcaggctgaggctcggctcttatgctaacctgaggccccatggctggcggccctgctggtgtggacgaccgctgtgtgcgtctcttgatggctggggagcattttgtttaaacaggatctttaaaatgaagtgtacgcttataatacaagtgatgcttgtgtatttctcactttaggaaataaaatatttgccaatttgatagaattttgactttaacgttaatcgtatttttagatattggttagcatattttatgttaggttattttcatttgattttatctagttgtacgtagaagatactgtcatcttttaggacaaagtattgtaaaattatctgttttagcccatgttctgatgacccacagctctgtcacctttgagcatcatctccccattctaagtttttttcccacttaattcctaaccctgcctctttgaggaagcccattgacggggcaattaaaaccttctcattgctcctgagaccagaacggcaagatgtttcctttcagaagctgagagccacaaggaggacagcagtgagcatctgcacagaaacgagctcagagacgcccgtgttcagtggagcacgccgatggggtgggcgccctggctctagacgctctcctaacacacctgtgctttgatgacagtctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagc

SEQ ID NO: 167247 - DNA, 3609 bp, Homo sapiens
  Payload ID: 12907
  Gene Symbol: PCGF3
  Gene Name: polycomb group ring finger 3
  ENST ID: ENST00000440452
  CDS Start-End: 317-661
ttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggaggctcccgtgtcctcagtatgcatcaggtctcccgaacctcacagccccgcagggaggaggagaaggggaggatttgactttggaagtctctgtgaccagaagccaaagatgttgaccaggaagatcaagctgtgggacatcaacgcccacatcacctgccgcctgtgcagcgggtacctcatcgacgccaccacggtgaccgagtgtctgcacacctctcaagcccgacaaaagcaggaaccaggaccaggggcagagacgatcttgaagataagtcagaaaagtcatttcacgctaaaggtcctgtgggtggtgtcagagcagatgaggcctcgcttaggagagcgaaacacaggagagaccccacattcctcccacggagcagcaaggccagtagccgctgtgacagtgctcactgctggcagtttccaaatctccagaggagttccttagatccttcaaaggggaaccttccagtgtgttcttcacacctgatgtgcgtcctcacacctgatgagtctgtgctttggtgttagaggactcacacctggggctggacctgagtgtttttctaagtgtggctaccgctgacgggcaggtgccatccatcaggctgaggctcggctcttatgctaacctgaggccccatggctggcggccctgctggtgtggacgaccgctgtgtgcgtctcttgatggctggggagcattttgtttaaacaggatctttaaaatgaagtgtacgcttataatacaagtgatgcttgtgtatttctcactttaggaaataaaatatttgccaatttgatagaattttgactttaacgttaatcgtatttttagatattggttagcatattttatgttaggttattttcatttgattttatctagttgtacgtagaagatactgtcatcttttaggacaaagtattgtaaaattatctgttttagcccatgttctgatgacccacagctctgtcacctttgagcatcatctccccattctaagtttttttcccacttaattcctaaccctgcctctttgaggaagcccattgacggggcaattaaaaccttctcattgctcctgagaccagaacggcaagatgtttcctttcagaagctgagagccacaaggaggacagcagtgagcatctgcacagaaacgagctcagagacgcccgtgttcagtggagcacgccgatggggtgggcgccctggctctagacgctctcctaacacacctgtgctttgatgacagtctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctc

SEQ ID NO: 167248 - DNA, 589 bp, Homo sapiens
  Payload ID: 12907
  Gene Symbol: PCGF3
  Gene Name: polycomb group ring finger 3
  ENST ID: ENST00000419774
  CDS Start-End: 468-589
cttgccgcggggtgggagcccagacgcacaccgcgcatgctccgagcgcggcgcccccgacgcggcgctcggctcggctcgggcatttccgcctctttgttttaaactccggacgggcttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagccccgcagggaggaggagaaggggaggatttgactttggaagtctctgtgaccagaagccaaagatgttgaccaggaagatcaagctgtgggacatcaacgcccacatcacctgccgcctgtgcagcgggtacctcatcgacgccaccacggtgaccgagtgtctgcacaccttctgcaggagctg

SEQ ID NO: 167249 - DNA, 1652 bp, Homo sapiens
  Payload ID: 12907
  Gene Symbol: PCGF3
  Gene Name: polycomb group ring finger 3
  Uniprot ID: Q3KNV8
  ENST ID: ENST00000470161
  CDS Start-End: 395-1123
atgctccgagcgcggcgcccccgacgcggcgctcggctcggctcgggcatttccgcctctttgttttaaactccggacgggcttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcaggtgccgtttctgtgctagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaa

SEQ ID NO: 167250 - DNA, 1725 bp, Homo sapiens
  Payload ID: 12907
  Gene Symbol: PCGF3
  Gene Name: polycomb group ring finger 3
  Uniprot ID: Q3KNV8
  ENST ID: ENST00000505655
  CDS Start-End: 45-773
cggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctc

SEQ ID NO: 167251 - DNA, 1899 bp, Homo sapiens
  Payload ID: 12907
  Gene Symbol: PCGF3
  Gene Name: polycomb group ring finger 3
  ENST ID: ENST00000620529
  CDS Start-End: 788-1186
ttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcagggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccctgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagctt

SEQ ID NO: 167252 - DNA, 7018 bp, Homo sapiens
  Payload ID: 12908
  Gene Symbol: PCGF5
  Gene Name: polycomb group ring finger 5
  Uniprot ID: Q86SE9
  ENST ID: ENST00000336126
  CDS Start-End: 233-1003
gaggccggcgcgctggcgggcgaggagcggcggcggtggcggccgctggacatgggaaagcggaaccaccaaaaggagtgatgatcaacgatctcatgataaatctggatgctagttctcatgcctcaggacatcctactgggaacgacacaccagctcctgggatcagactttcatctacttaggacccctctttgcccagactactaaagccagtcttcactagccacgaatggctacccaaaggaaacacttggtgaaagattttaatccttacattacctgctatatctgtaaagggtatctgatcaagccaacaacagtgacggaatgcctccatacattctgtaagacttgtattgttcagcactttgaagatagcaatgattgcccaaggtgtggcaaccaagttcatgagacaaatccattagaaatgttgaggttggacaatacattagaggaaattatatttaagctggtccctggactacgagaacaagaacttgagcgtgaatctgaattttggaagaaaaataagcctcaagaaaatggacaagatgatacttcaaaagctgacaaaccgaaagtagatgaagaaggtgatgaaaatgaagatgataaagattatcacagaagtgacccacaaattgctatctgtctagattgtttacgaaataatgggcaatcaggggacaatgtagtaaagggtttaatgaagaaattcattcgatgttctacacgtgtaactgtgggaactattaaaaaatttctaagtttaaaactaaaacttccaagttcttatgagttggatgtgctgtgcaatggtgaaattatggggaaggatcatactatggaattcatctacatgacaagatggcgactaagaggcgaaaactttcggtgtctgaactgctcagcttcgcaagtctgctctcaggatggccctttgtatcagtcataccctatggtactgcagtatcgaccaagaattgatttcggttagaccaaggggcccagacctcactgagatgaatcctgcactatttgtttactcgtcaacagattgcacagttaacggtgtgtggactagaggaacacaaccagattttcagcatgcaaataaggccattgtctatctctaaattgtcagttgcattcatgttgtttctattaggagcaaaccaagtgccattctgctactgaaccatctgcataaggtatttgtgttgtctcaaagtgtgcaagtcatggtaaaaatcagttagctgtgccgccatgattcacccttctgaatattttgcttgcctgttccaagattgttctaatgtttaattacactagtaaaatggctcaatttttgtggtgttgcagttttcacatacttactcttttattcttgtttaaatagcgtactctacaagaaactaataattatatcttgaaattattttgtatggaagtatatttagaaaagtggtttttgagccactgtcttgttcttgataagctttttgtgtgaaaaaaagttcattcttgagtgtgcaagtccttttgccaagaattccaattattctgtaacattagagcacaatataattgtagacattctaagcatctgtccgtgtagtctaccaattgcacaaggaaggcatgttagccctccagattgaaaatgtatgtgacctcttgaactgaagttagattcccaaccattcaaaatgttggcagctgatcacatttacttctgataaaagtaatgtgtaagtaaggttaatcttctttcataatgccttatgacaagcaggtgctgcttcatgaaacgtcattgtatagcccatttcatgtatcattacattgttgctgttatttaatgagtgcattatttctctttttaagttggccttaggtatatgtcattgtggcatgcagagggttatgacgattttaaatattaggatttttagagcacataacattagctattttatggatttcaaaagtctcaaaacagttgtagattaaaactgttagttacctttcacatttccaaactatgtgcataaaatagaataaatgcagtatagaactatgctaaccaaaattaataggttaagggtattttattttaaatcctgtagtaattggggaaatgagaagattattattttatacatgagttcattaagatcagaaatacaaaatgtcctgtattttgcagttttgttaagtcttccattcgttttaggattagtctgcaagtcaaagaaagtcttgttaccttaaattatatgaaaactgtcattttaaatcttttaatatttacagttttcaaaaaccttacttggaaattgctttgaaacaaacaagctaacctttgaaacttaggaaaaaatcttgaaagttaggaaaaatatttgagaaatatgacgagcacaatctgtgtgttacacacatttagtttttatactgcatatgtggtaaatgtgtcacattttccagtaaaatgtatcagaaatcaatgccttctgaatttcaaaatgattcttagaaataagatattgtacaactctagcaaacatacaaagtacagctaaatcttaatatatttcactatgtaaaaggctgaaacttcataattatctgttccttctatctttttttgagtcaaaaagtctattaaatttttctgttgttgttccaactttggtgaaaaaggttatggcaatactttaactttgttttgttacattgtttttgttcttggaatggctcacaagcagaatttaaaaggcagattttcattaactataaatggctgaaaaaactgaatttactatctagctacagaaattatttttctatggtgtgaaactgttcccagacatccctaagaacttttacaaattattataaatttgtcacacctaggtcagcgattaaaatagtgttttgcaaatggaattttaattaactcaaaatgaattaagagtgcattttaaaaatcacaagtgagactttgatgttttggccccccagccaaaacttaatggtcataaatgaattttatctacaaaatctctttaaatttggctggttgccttgtcatatgtaatttcactattttccaaggaaatatataggaagcaattatgaaactgagaatagttttatatagaattcttttatttactgataatgcattaacatttttattgaaatgcaatggaatatgtgccaaaacacgtgaaaagcttacataaagaaaggcatcagttgtcgtttggagaaaggtacacatttttttgatggtcctaagtgatatggtattactactagaatcacagatttcttcaactgacttattttggtatattcaactacagctttctaaggataggactactttcatgtctagtaatacactgtattccccgttaattatcccttaagtcagattgtagaatttgcaagaaactaggtatagaaaaaatgtacaggcaacttttgtggttagctttataaatttagggtgcttataaaatgataaaatgaattctttaaataacctataggaatcatctgaatctgtaacatcagagactaaaactaaaagttttctttaatctgttgtttcttaagcaataaactgaaagacctttacttccataaaagattttgttatctcttttatctgccttagaaattataagtataaaagggtcaagggaacttagatataaagaatgactgtggtttataaacattactttaattgaagtaatcacatcagttaatagagaaatcaaaatatgtatggccttttctctagattagcaaaacagctttacaaagtatgaaaaaataaactaaaatgctcattgatgaggtaatactcagtctggagtacaggtaacttgggtaatgccttttaactactcttagaggagtatattatttctttatacattaaacatctatcccatagtaatgtgccacattttataaacgtaatgactttgctcaactacattacacactcaaatgtaatctaaatttaaactgattatttaaggaaaaaaagtgtgttatataatattgtgaactgtttagctttactgaaatatttaagagaaagtgcctcattactaaagtgcatttctgttttaaatttactgcataaagtttgagttatctgtacctgtctcttatgaatggtttcatatctaaataggctcttgtaagttaatttttttggaagattttcataagaatatagatatcaccaaagacattttacagtaaattaataaccatgttggagagacggttttaacagtttggaggttggaaatttttagattgcaatttaattttatatagttaggcaataaccttgattaattgctaaaatatcaccaaagaaaggctttaaactgaattttcttggtgagatcagtcaaatgcaggcttttcttgcaataatcagaacacacttcctttcaaatatgttcattgtttttcagcatcatctaacagatcttagtaaatctaaatcctcaaagatgagaaagaggtaaacacaacaaatagccttcctctgcatgaaaagtgagagaaatacatactttgaaaagaaagttcagatttttaatttgagagggtttttatttcatggaggcagtgttaactaaaattaagcttagatttagctcctgtattattcataatatgagaaattttattaaaggcagactttggtaaaagtgccaacacacttacttgtatagaaaagacttcattctatgggatttatataagtaagtgctttctctatattcaaaatatttcataaggacctgtggtttttttccccttaaaaagcaactctaggccgggcacagtggctcatgcctgtaatcccagcactttgggaggccaaggcaggtggatcacttgaggtcaggagttcgagaccagctggttaacatggtgaaaccccatctctactaaaaatacaaaaattagccaggtgtggtggcacgcgcctgtaatcccagctacatgggaggttgaggcaggagaatctcttgaacccaggaggtggaggttgcagtgagccgcaattacaccactgcactccagcctgggtgacacagcgagtctccatctccaaaaaaaattcaactcttggtcttgtttctcagcacttagtttattgttattagaatttagccatacagccaactttgacaaaatgggtcacagaacaagcatgtacatcaagaggaagttccatatcccccttgtaccatttctccttgggaactcatgctatgggctaccttaaaggtaaaactcatcttatggagtctttctgataggtcactaggtaaaactccttggatagggtgaaaatggatgcacactctattacatactctggtttatcataaggaattttccagaaagctaagctttatactaataagatattggttggtagtaggaacttcaaaaatgaatgagtttgccataactttaattttctggattagaaacacaaaacttgaaatgcaattatcaatattttgtaatatatattcctacagtttgggtagaaataaggaacatgtctgctagatctggtttatgaaaaagtgaaaaatattaaatacaccagagactcaaaccctttcaaggcacacaataactgttctggatttacctgacaaacctagttgagtagcattttgacagaaaatatcagactgaaagttcattcaaatgtacttaaatgtacaatacagtgttcaatagtttttattgcagtgatgtttttccaataatttaagtaattctcttcctagtataatacagttttcataaataatgtttacttgctttctttatattttcaaataaaattaaaatgctcgagcacttcctttcagaaagttataaaattaaaaataattattttaaatgctcattcaaatgtgtctgtatacttgctatgcccctttttctataattccaaactgagactgatttttcagagatttttaactttaataattttaaatctagaatcaagtgaaacagatatgttaaatactgagtctagttttcttccatcttatggagcttcatggaataagaaactaatctagtgcaaatgaagattaaatatttctgggtgatggagagatagtcaacaaatttatttatccatcctctgcacatcagtccactggagcaggagttctacacattaaaaatgtaatgggatcagcctagcattgtttggtgttcttttgttgtattttttagaatgggggtgggggcctaagtgtccttatgaagctgtggtccacgacaggagcttgttgggggagtaccagggttctgctgctttcctgcatctgagcaacacaacagagatcatcagttttaaatagagtagccctcacaatcaaaatatcatagaatatattgtaaagttatgttgctaattttcctttgaaatataaaatattttaagctttttgtcaaaagtggtaacatcttaatacaaataaaaacctttttgtggttgtaagatttagcttataaatcattcaaattgaagtgaaagaattaccaggtcattgttaatgacttagtctattaagaatatatgtatttttgtaaaggaaaagcacttgtagatatttaatcagtacaagatatgtcttttgcagaaataaaatgctgcttagagattctccttaaatattttttatttttgtgctcaaatgtattttctgttgatctatggaatgttctgtacaaagctgtataattgtactgttgggctagatactttttttttttaatctggacttagccaagtatatttcaccatgttaaaatacagtatctttgttattaaaaattaaattgcataatttattattgtttgtcatctttaatattagtcactgtagattgcagccttcattaaaaatatctcctttaa

SEQ ID NO: 167253 - DNA, 7144 bp, Homo sapiens
  Payload ID: 12908
  Gene Symbol: PCGF5
  Gene Name: polycomb group ring finger 5
  Uniprot ID: Q86SE9
  ENST ID: ENST00000543648
  CDS Start-End: 361-1131
cacaacgttcccgtttgcttatagttgtcaacgaccatgatctctggacccacactacagtaacaagtttgtcagtcattttcagataaggtgcaaatcaagggatggctttgtccccacttcggcgcaggtgggacagacttggggaagacgcagctgaagagacaaattctcaggacatgggaaagcggaaccaccaaaaggagtgatgatcaacgatctcatgataaatctggatgctagttctcatgcctcaggacatcctactgggaacgacacaccagctcctgggatcagactttcatctacttaggacccctctttgcccagactactaaagccagtcttcactagccacgaatggctacccaaaggaaacacttggtgaaagattttaatccttacattacctgctatatctgtaaagggtatctgatcaagccaacaacagtgacggaatgcctccatacattctgtaagacttgtattgttcagcactttgaagatagcaatgattgcccaaggtgtggcaaccaagttcatgagacaaatccattagaaatgttgaggttggacaatacattagaggaaattatatttaagctggtccctggactacgagaacaagaacttgagcgtgaatctgaattttggaagaaaaataagcctcaagaaaatggacaagatgatacttcaaaagctgacaaaccgaaagtagatgaagaaggtgatgaaaatgaagatgataaagattatcacagaagtgacccacaaattgctatctgtctagattgtttacgaaataatgggcaatcaggggacaatgtagtaaagggtttaatgaagaaattcattcgatgttctacacgtgtaactgtgggaactattaaaaaatttctaagtttaaaactaaaacttccaagttcttatgagttggatgtgctgtgcaatggtgaaattatggggaaggatcatactatggaattcatctacatgacaagatggcgactaagaggcgaaaactttcggtgtctgaactgctcagcttcgcaagtctgctctcaggatggccctttgtatcagtcataccctatggtactgcagtatcgaccaagaattgatttcggttagaccaaggggcccagacctcactgagatgaatcctgcactatttgtttactcgtcaacagattgcacagttaacggtgtgtggactagaggaacacaaccagattttcagcatgcaaataaggccattgtctatctctaaattgtcagttgcattcatgttgtttctattaggagcaaaccaagtgccattctgctactgaaccatctgcataaggtatttgtgttgtctcaaagtgtgcaagtcatggtaaaaatcagttagctgtgccgccatgattcacccttctgaatattttgcttgcctgttccaagattgttctaatgtttaattacactagtaaaatggctcaatttttgtggtgttgcagttttcacatacttactcttttattcttgtttaaatagcgtactctacaagaaactaataattatatcttgaaattattttgtatggaagtatatttagaaaagtggtttttgagccactgtcttgttcttgataagctttttgtgtgaaaaaaagttcattcttgagtgtgcaagtccttttgccaagaattccaattattctgtaacattagagcacaatataattgtagacattctaagcatctgtccgtgtagtctaccaattgcacaaggaaggcatgttagccctccagattgaaaatgtatgtgacctcttgaactgaagttagattcccaaccattcaaaatgttggcagctgatcacatttacttctgataaaagtaatgtgtaagtaaggttaatcttctttcataatgccttatgacaagcaggtgctgcttcatgaaacgtcattgtatagcccatttcatgtatcattacattgttgctgttatttaatgagtgcattatttctctttttaagttggccttaggtatatgtcattgtggcatgcagagggttatgacgattttaaatattaggatttttagagcacataacattagctattttatggatttcaaaagtctcaaaacagttgtagattaaaactgttagttacctttcacatttccaaactatgtgcataaaatagaataaatgcagtatagaactatgctaaccaaaattaataggttaagggtattttattttaaatcctgtagtaattggggaaatgagaagattattattttatacatgagttcattaagatcagaaatacaaaatgtcctgtattttgcagttttgttaagtcttccattcgttttaggattagtctgcaagtcaaagaaagtcttgttaccttaaattatatgaaaactgtcattttaaatcttttaatatttacagttttcaaaaaccttacttggaaattgctttgaaacaaacaagctaacctttgaaacttaggaaaaaatcttgaaagttaggaaaaatatttgagaaatatgacgagcacaatctgtgtgttacacacatttagtttttatactgcatatgtggtaaatgtgtcacattttccagtaaaatgtatcagaaatcaatgccttctgaatttcaaaatgattcttagaaataagatattgtacaactctagcaaacatacaaagtacagctaaatcttaatatatttcactatgtaaaaggctgaaacttcataattatctgttccttctatctttttttgagtcaaaaagtctattaaatttttctgttgttgttccaactttggtgaaaaaggttatggcaatactttaactttgttttgttacattgtttttgttcttggaatggctcacaagcagaatttaaaaggcagattttcattaactataaatggctgaaaaaactgaatttactatctagctacagaaattatttttctatggtgtgaaactgttcccagacatccctaagaacttttacaaattattataaatttgtcacacctaggtcagcgattaaaatagtgttttgcaaatggaattttaattaactcaaaatgaattaagagtgcattttaaaaatcacaagtgagactttgatgttttggccccccagccaaaacttaatggtcataaatgaattttatctacaaaatctctttaaatttggctggttgccttgtcatatgtaatttcactattttccaaggaaatatataggaagcaattatgaaactgagaatagttttatatagaattcttttatttactgataatgcattaacatttttattgaaatgcaatggaatatgtgccaaaacacgtgaaaagcttacataaagaaaggcatcagttgtcgtttggagaaaggtacacatttttttgatggtcctaagtgatatggtattactactagaatcacagatttcttcaactgacttattttggtatattcaactacagctttctaaggataggactactttcatgtctagtaatacactgtattccccgttaattatcccttaagtcagattgtagaatttgcaagaaactaggtatagaaaaaatgtacaggcaacttttgtggttagctttataaatttagggtgcttataaaatgataaaatgaattctttaaataacctataggaatcatctgaatctgtaacatcagagactaaaactaaaagttttctttaatctgttgtttcttaagcaataaactgaaagacctttacttccataaaagattttgttatctcttttatctgccttagaaattataagtataaaagggtcaagggaacttagatataaagaatgactgtggtttataaacattactttaattgaagtaatcacatcagttaatagagaaatcaaaatatgtatggccttttctctagattagcaaaacagctttacaaagtatgaaaaaataaactaaaatgctcattgatgaggtaatactcagtctggagtacaggtaacttgggtaatgccttttaactactcttagaggagtatattatttctttatacattaaacatctatcccatagtaatgtgccacattttataaacgtaatgactttgctcaactacattacacactcaaatgtaatctaaatttaaactgattatttaaggaaaaaaagtgtgttatataatattgtgaactgtttagctttactgaaatatttaagagaaagtgcctcattactaaagtgcatttctgttttaaatttactgcataaagtttgagttatctgtacctgtctcttatgaatggtttcatatctaaataggctcttgtaagttaatttttttggaagattttcataagaatatagatatcaccaaagacattttacagtaaattaataaccatgttggagagacggttttaacagtttggaggttggaaatttttagattgcaatttaattttatatagttaggcaataaccttgattaattgctaaaatatcaccaaagaaaggctttaaactgaattttcttggtgagatcagtcaaatgcaggcttttcttgcaataatcagaacacacttcctttcaaatatgttcattgtttttcagcatcatctaacagatcttagtaaatctaaatcctcaaagatgagaaagaggtaaacacaacaaatagccttcctctgcatgaaaagtgagagaaatacatactttgaaaagaaagttcagatttttaatttgagagggtttttatttcatggaggcagtgttaactaaaattaagcttagatttagctcctgtattattcataatatgagaaattttattaaaggcagactttggtaaaagtgccaacacacttacttgtatagaaaagacttcattctatgggatttatataagtaagtgctttctctatattcaaaatatttcataaggacctgtggtttttttccccttaaaaagcaactctaggccgggcacagtggctcatgcctgtaatcccagcactttgggaggccaaggcaggtggatcacttgaggtcaggagttcgagaccagctggttaacatggtgaaaccccatctctactaaaaatacaaaaattagccaggtgtggtggcacgcgcctgtaatcccagctacatgggaggttgaggcaggagaatctcttgaacccaggaggtggaggttgcagtgagccgcaattacaccactgcactccagcctgggtgacacagcgagtctccatctccaaaaaaaattcaactcttggtcttgtttctcagcacttagtttattgttattagaatttagccatacagccaactttgacaaaatgggtcacagaacaagcatgtacatcaagaggaagttccatatcccccttgtaccatttctccttgggaactcatgctatgggctaccttaaaggtaaaactcatcttatggagtctttctgataggtcactaggtaaaactccttggatagggtgaaaatggatgcacactctattacatactctggtttatcataaggaattttccagaaagctaagctttatactaataagatattggttggtagtaggaacttcaaaaatgaatgagtttgccataactttaattttctggattagaaacacaaaacttgaaatgcaattatcaatattttgtaatatatattcctacagtttgggtagaaataaggaacatgtctgctagatctggtttatgaaaaagtgaaaaatattaaatacaccagagactcaaaccctttcaaggcacacaataactgttctggatttacctgacaaacctagttgagtagcattttgacagaaaatatcagactgaaagttcattcaaatgtacttaaatgtacaatacagtgttcaatagtttttattgcagtgatgtttttccaataatttaagtaattctcttcctagtataatacagttttcataaataatgtttacttgctttctttatattttcaaataaaattaaaatgctcgagcacttcctttcagaaagttataaaattaaaaataattattttaaatgctcattcaaatgtgtctgtatacttgctatgcccctttttctataattccaaactgagactgatttttcagagatttttaactttaataattttaaatctagaatcaagtgaaacagatatgttaaatactgagtctagttttcttccatcttatggagcttcatggaataagaaactaatctagtgcaaatgaagattaaatatttctgggtgatggagagatagtcaacaaatttatttatccatcctctgcacatcagtccactggagcaggagttctacacattaaaaatgtaatgggatcagcctagcattgtttggtgttcttttgttgtattttttagaatgggggtgggggcctaagtgtccttatgaagctgtggtccacgacaggagcttgttgggggagtaccagggttctgctgctttcctgcatctgagcaacacaacagagatcatcagttttaaatagagtagccctcacaatcaaaatatcatagaatatattgtaaagttatgttgctaattttcctttgaaatataaaatattttaagctttttgtcaaaagtggtaacatcttaatacaaataaaaacctttttgtggttgtaagatttagcttataaatcattcaaattgaagtgaaagaattaccaggtcattgttaatgacttagtctattaagaatatatgtatttttgtaaaggaaaagcacttgtagatatttaatcagtacaagatatgtcttttgcagaaataaaatgctgcttagagattctccttaaatattttttatttttgtgctcaaatgtattttctgttgatctatggaatgttctgtacaaagctgtataattgtactgttgggctagatactttttttttttaatctggacttagccaagtatatttcaccatgttaaaatacagtatctttgttattaaaaattaaattgcataatttattattgtttgtcatctttaatattagtcactgtagattgcagccttcattaaaaatatctccttt

SEQ ID NO: 167254 - DNA, 7037 bp, Homo sapiens
  Payload ID: 12908
  Gene Symbol: PCGF5
  Gene Name: polycomb group ring finger 5
  Uniprot ID: Q86SE9
  ENST ID: ENST00000614189
  CDS Start-End: 254-1024
cccacgcgcgcgcgctcgcgcaccacgcgccccgcgcggcccgcccggatcgtggcctctcgagagcaagacatgggaaagcggaaccaccaaaaggagtgatgatcaacgatctcatgataaatctggatgctagttctcatgcctcaggacatcctactgggaacgacacaccagctcctgggatcagactttcatctacttaggacccctctttgcccagactactaaagccagtcttcactagccacgaatggctacccaaaggaaacacttggtgaaagattttaatccttacattacctgctatatctgtaaagggtatctgatcaagccaacaacagtgacggaatgcctccatacattctgtaagacttgtattgttcagcactttgaagatagcaatgattgcccaaggtgtggcaaccaagttcatgagacaaatccattagaaatgttgaggttggacaatacattagaggaaattatatttaagctggtccctggactacgagaacaagaacttgagcgtgaatctgaattttggaagaaaaataagcctcaagaaaatggacaagatgatacttcaaaagctgacaaaccgaaagtagatgaagaaggtgatgaaaatgaagatgataaagattatcacagaagtgacccacaaattgctatctgtctagattgtttacgaaataatgggcaatcaggggacaatgtagtaaagggtttaatgaagaaattcattcgatgttctacacgtgtaactgtgggaactattaaaaaatttctaagtttaaaactaaaacttccaagttcttatgagttggatgtgctgtgcaatggtgaaattatggggaaggatcatactatggaattcatctacatgacaagatggcgactaagaggcgaaaactttcggtgtctgaactgctcagcttcgcaagtctgctctcaggatggccctttgtatcagtcataccctatggtactgcagtatcgaccaagaattgatttcggttagaccaaggggcccagacctcactgagatgaatcctgcactatttgtttactcgtcaacagattgcacagttaacggtgtgtggactagaggaacacaaccagattttcagcatgcaaataaggccattgtctatctctaaattgtcagttgcattcatgttgtttctattaggagcaaaccaagtgccattctgctactgaaccatctgcataaggtatttgtgttgtctcaaagtgtgcaagtcatggtaaaaatcagttagctgtgccgccatgattcacccttctgaatattttgcttgcctgttccaagattgttctaatgtttaattacactagtaaaatggctcaatttttgtggtgttgcagttttcacatacttactcttttattcttgtttaaatagcgtactctacaagaaactaataattatatcttgaaattattttgtatggaagtatatttagaaaagtggtttttgagccactgtcttgttcttgataagctttttgtgtgaaaaaaagttcattcttgagtgtgcaagtccttttgccaagaattccaattattctgtaacattagagcacaatataattgtagacattctaagcatctgtccgtgtagtctaccaattgcacaaggaaggcatgttagccctccagattgaaaatgtatgtgacctcttgaactgaagttagattcccaaccattcaaaatgttggcagctgatcacatttacttctgataaaagtaatgtgtaagtaaggttaatcttctttcataatgccttatgacaagcaggtgctgcttcatgaaacgtcattgtatagcccatttcatgtatcattacattgttgctgttatttaatgagtgcattatttctctttttaagttggccttaggtatatgtcattgtggcatgcagagggttatgacgattttaaatattaggatttttagagcacataacattagctattttatggatttcaaaagtctcaaaacagttgtagattaaaactgttagttacctttcacatttccaaactatgtgcataaaatagaataaatgcagtatagaactatgctaaccaaaattaataggttaagggtattttattttaaatcctgtagtaattggggaaatgagaagattattattttatacatgagttcattaagatcagaaatacaaaatgtcctgtattttgcagttttgttaagtcttccattcgttttaggattagtctgcaagtcaaagaaagtcttgttaccttaaattatatgaaaactgtcattttaaatcttttaatatttacagttttcaaaaaccttacttggaaattgctttgaaacaaacaagctaacctttgaaacttaggaaaaaatcttgaaagttaggaaaaatatttgagaaatatgacgagcacaatctgtgtgttacacacatttagtttttatactgcatatgtggtaaatgtgtcacattttccagtaaaatgtatcagaaatcaatgccttctgaatttcaaaatgattcttagaaataagatattgtacaactctagcaaacatacaaagtacagctaaatcttaatatatttcactatgtaaaaggctgaaacttcataattatctgttccttctatctttttttgagtcaaaaagtctattaaatttttctgttgttgttccaactttggtgaaaaaggttatggcaatactttaactttgttttgttacattgtttttgttcttggaatggctcacaagcagaatttaaaaggcagattttcattaactataaatggctgaaaaaactgaatttactatctagctacagaaattatttttctatggtgtgaaactgttcccagacatccctaagaacttttacaaattattataaatttgtcacacctaggtcagcgattaaaatagtgttttgcaaatggaattttaattaactcaaaatgaattaagagtgcattttaaaaatcacaagtgagactttgatgttttggccccccagccaaaacttaatggtcataaatgaattttatctacaaaatctctttaaatttggctggttgccttgtcatatgtaatttcactattttccaaggaaatatataggaagcaattatgaaactgagaatagttttatatagaattcttttatttactgataatgcattaacatttttattgaaatgcaatggaatatgtgccaaaacacgtgaaaagcttacataaagaaaggcatcagttgtcgtttggagaaaggtacacatttttttgatggtcctaagtgatatggtattactactagaatcacagatttcttcaactgacttattttggtatattcaactacagctttctaaggataggactactttcatgtctagtaatacactgtattccccgttaattatcccttaagtcagattgtagaatttgcaagaaactaggtatagaaaaaatgtacaggcaacttttgtggttagctttataaatttagggtgcttataaaatgataaaatgaattctttaaataacctataggaatcatctgaatctgtaacatcagagactaaaactaaaagttttctttaatctgttgtttcttaagcaataaactgaaagacctttacttccataaaagattttgttatctcttttatctgccttagaaattataagtataaaagggtcaagggaacttagatataaagaatgactgtggtttataaacattactttaattgaagtaatcacatcagttaatagagaaatcaaaatatgtatggccttttctctagattagcaaaacagctttacaaagtatgaaaaaataaactaaaatgctcattgatgaggtaatactcagtctggagtacaggtaacttgggtaatgccttttaactactcttagaggagtatattatttctttatacattaaacatctatcccatagtaatgtgccacattttataaacgtaatgactttgctcaactacattacacactcaaatgtaatctaaatttaaactgattatttaaggaaaaaaagtgtgttatataatattgtgaactgtttagctttactgaaatatttaagagaaagtgcctcattactaaagtgcatttctgttttaaatttactgcataaagtttgagttatctgtacctgtctcttatgaatggtttcatatctaaataggctcttgtaagttaatttttttggaagattttcataagaatatagatatcaccaaagacattttacagtaaattaataaccatgttggagagacggttttaacagtttggaggttggaaatttttagattgcaatttaattttatatagttaggcaataaccttgattaattgctaaaatatcaccaaagaaaggctttaaactgaattttcttggtgagatcagtcaaatgcaggcttttcttgcaataatcagaacacacttcctttcaaatatgttcattgtttttcagcatcatctaacagatcttagtaaatctaaatcctcaaagatgagaaagaggtaaacacaacaaatagccttcctctgcatgaaaagtgagagaaatacatactttgaaaagaaagttcagatttttaatttgagagggtttttatttcatggaggcagtgttaactaaaattaagcttagatttagctcctgtattattcataatatgagaaattttattaaaggcagactttggtaaaagtgccaacacacttacttgtatagaaaagacttcattctatgggatttatataagtaagtgctttctctatattcaaaatatttcataaggacctgtggtttttttccccttaaaaagcaactctaggccgggcacagtggctcatgcctgtaatcccagcactttgggaggccaaggcaggtggatcacttgaggtcaggagttcgagaccagctggttaacatggtgaaaccccatctctactaaaaatacaaaaattagccaggtgtggtggcacgcgcctgtaatcccagctacatgggaggttgaggcaggagaatctcttgaacccaggaggtggaggttgcagtgagccgcaattacaccactgcactccagcctgggtgacacagcgagtctccatctccaaaaaaaattcaactcttggtcttgtttctcagcacttagtttattgttattagaatttagccatacagccaactttgacaaaatgggtcacagaacaagcatgtacatcaagaggaagttccatatcccccttgtaccatttctccttgggaactcatgctatgggctaccttaaaggtaaaactcatcttatggagtctttctgataggtcactaggtaaaactccttggatagggtgaaaatggatgcacactctattacatactctggtttatcataaggaattttccagaaagctaagctttatactaataagatattggttggtagtaggaacttcaaaaatgaatgagtttgccataactttaattttctggattagaaacacaaaacttgaaatgcaattatcaatattttgtaatatatattcctacagtttgggtagaaataaggaacatgtctgctagatctggtttatgaaaaagtgaaaaatattaaatacaccagagactcaaaccctttcaaggcacacaataactgttctggatttacctgacaaacctagttgagtagcattttgacagaaaatatcagactgaaagttcattcaaatgtacttaaatgtacaatacagtgttcaatagtttttattgcagtgatgtttttccaataatttaagtaattctcttcctagtataatacagttttcataaataatgtttacttgctttctttatattttcaaataaaattaaaatgctcgagcacttcctttcagaaagttataaaattaaaaataattattttaaatgctcattcaaatgtgtctgtatacttgctatgcccctttttctataattccaaactgagactgatttttcagagatttttaactttaataattttaaatctagaatcaagtgaaacagatatgttaaatactgagtctagttttcttccatcttatggagcttcatggaataagaaactaatctagtgcaaatgaagattaaatatttctgggtgatggagagatagtcaacaaatttatttatccatcctctgcacatcagtccactggagcaggagttctacacattaaaaatgtaatgggatcagcctagcattgtttggtgttcttttgttgtattttttagaatgggggtgggggcctaagtgtccttatgaagctgtggtccacgacaggagcttgttgggggagtaccagggttctgctgctttcctgcatctgagcaacacaacagagatcatcagttttaaatagagtagccctcacaatcaaaatatcatagaatatattgtaaagttatgttgctaattttcctttgaaatataaaatattttaagctttttgtcaaaagtggtaacatcttaatacaaataaaaacctttttgtggttgtaagatttagcttataaatcattcaaattgaagtgaaagaattaccaggtcattgttaatgacttagtctattaagaatatatgtatttttgtaaaggaaaagcacttgtagatatttaatcagtacaagatatgtcttttgcagaaataaaatgctgcttagagattctccttaaatattttttatttttgtgctcaaatgtattttctgttgatctatggaatgttctgtacaaagctgtataattgtactgttgggctagatactttttttttttaatctggacttagccaagtatatttcaccatgttaaaatacagtatctttgttattaaaaattaaattgcataatttattattgtttgtcatctttaatattagtcactgtagattgcagccttcattaaaaatatctccttt

SEQ ID NO: 167255 - DNA, 1950 bp, Homo sapiens
  Payload ID: 12909
  Gene Symbol: PCGF6
  Gene Name: polycomb group ring finger 6
  Uniprot ID: Q9BYE7
  ENST ID: ENST00000337211
  CDS Start-End: 14-841
gtctctcccgaccatggagggggtcgcggtggtgacggcgggcagcgtaggcgctgccaaaaccgagggagctgcagccttgccgcctccgcctcctgtctccccgcccgccctcacccctgcacccgcagcgggtgaggagggaccggcgcctctgtctgagacgggggctcccggctgctccggctcccggccccctgagctggagccggagcgcagcctgggccgcttcagaggccgcttcgaggacgaggacgaggagttggaagaagaagaggagctggaggaggaagaagaggaggaggaggaggacatgagtcacttctcgttgaggctggagggaggccggcaggactcggaggacgaggaggagcgcctgattaatctctctgagctgaccccatacatcttgtgttccatttgcaaaggttacttaatagatgcaactaccatcacagaatgtcttcataccttttgtaaaagctgcatcgtaagacatttttactacagcaacagatgtccaaaatgcaatatagtagtacatcagacacaacctctttataacataagtgctaatgaaggcacgggacattttaagccattggaaaagaagtttgttcgagtttcaggagaagcaactattggacatgtagaaaaattcctcagaagaaaaatgggtcttgatccagcttgtcaggtagatataatctgtggtgatcacctgttggagcagtatcaaactctaagggaaatccgacgtgcaataggtgatgcagcaatgcaggatggtctgcttgtccttcattatggtcttgtggtttctcctctgaagataacttgaagattctaggcacattatgaggagggaaacaaaggaggcttctgcaggactgcatctcaccaaagatttccatgaaatgtaattgctaccactttgctgttcaagacataacttacctatttttagcaccaagaattatagcgtttataagtacaacttggaacgatggaatgcatctgttactagagactgtatataaaaagcagccaaagctcaggggaaatttttcaaaaattgaattttaaaatttcttatgattttaaataccttgacattgattttgcttcccatctttgaagtaattggttagttttctttgttcagccatttcaagttggtggttgggatatctgctctctgggatggcatcagttgggcagtcatctttttggaagagaagtgtgcttttgagtggaagattcaaagccagtctttgttaaactgcagggtgtactctcaaagaccaaaactattggccacttttgtatgttgccagcatattttgaacttgtacctttttttatactagcaacactacaaaggagaagttactcatttcaaaatggatgaattgttattatgtgtgaagagactctgagtttatgatctgtgccataaaatttcagtgtaataagacttcttcaatacatcttccaataaggggtgcttctttgtgacagtatttttatttctgacattcattttatttgggtacatagtgtggttgttgataccttgcaatagtattgcttctgaaagtaataaaaaattttaggagaatttgagaagtttacagaattacttattcattgttttcttagtaagtcagtttaatgtttatttttctcattatttcatcactgcaataaagaataagggtgtttgagctcacctccatgcaaagacttcagttttaaaacattatttgcctaaaattagcattgtgatgctttctgaaagaaatattttataaatcctgtttaacagcagaatttctgaatgtgtagagactactacaaaattggaaaaagattggcaattctttgtaaagaatttgtgaattgtgtataaatttattctaacatttaataaaaatgtattttaaccta

SEQ ID NO: 167256 - DNA, 2230 bp, Homo sapiens
  Payload ID: 12909
  Gene Symbol: PCGF6
  Gene Name: polycomb group ring finger 6
  Uniprot ID: Q9BYE7
  ENST ID: ENST00000369847
  CDS Start-End: 69-1121
ggcgtccgaggccggccgaactcccgcgctctcccgccgcctcgcctcgcctggtgtctctcccgaccatggagggggtcgcggtggtgacggcgggcagcgtaggcgctgccaaaaccgagggagctgcagccttgccgcctccgcctcctgtctccccgcccgccctcacccctgcacccgcagcgggtgaggagggaccggcgcctctgtctgagacgggggctcccggctgctccggctcccggccccctgagctggagccggagcgcagcctgggccgcttcagaggccgcttcgaggacgaggacgaggagttggaagaagaagaggagctggaggaggaagaagaggaggaggaggaggacatgagtcacttctcgttgaggctggagggaggccggcaggactcggaggacgaggaggagcgcctgattaatctctctgagctgaccccatacatcttgtgttccatttgcaaaggttacttaatagatgcaactaccatcacagaatgtcttcataccttttgtaaaagctgcatcgtaagacatttttactacagcaacagatgtccaaaatgcaatatagtagtacatcagacacaacctctttataacataaggttggaccgacagttacaagacatagtgtacaaattagtgatcaatctagaggaaagagaaaaaaagcaaatgcatgatttctataaagaaagaggtctagaagtacctaaacctgctgttccacagccagtcccttcaagcaaaggaagatctaaaaaagtcctagaatcagtgtttcgtattccacctgaacttgatatgtctttattactggagttcattggtgctaatgaaggcacgggacattttaagccattggaaaagaagtttgttcgagtttcaggagaagcaactattggacatgtagaaaaattcctcagaagaaaaatgggtcttgatccagcttgtcaggtagatataatctgtggtgatcacctgttggagcagtatcaaactctaagggaaatccgacgtgcaataggtgatgcagcaatgcaggatggtctgcttgtccttcattatggtcttgtggtttctcctctgaagataacttgaagattctaggcacattatgaggagggaaacaaaggaggcttctgcaggactgcatctcaccaaagatttccatgaaatgtaattgctaccactttgctgttcaagacataacttacctatttttagcaccaagaattatagcgtttataagtacaacttggaacgatggaatgcatctgttactagagactgtatataaaaagcagccaaagctcaggggaaatttttcaaaaattgaattttaaaatttcttatgattttaaataccttgacattgattttgcttcccatctttgaagtaattggttagttttctttgttcagccatttcaagttggtggttgggatatctgctctctgggatggcatcagttgggcagtcatctttttggaagagaagtgtgcttttgagtggaagattcaaagccagtctttgttaaactgcagggtgtactctcaaagaccaaaactattggccacttttgtatgttgccagcatattttgaacttgtacctttttttatactagcaacactacaaaggagaagttactcatttcaaaatggatgaattgttattatgtgtgaagagactctgagtttatgatctgtgccataaaatttcagtgtaataagacttcttcaatacatcttccaataaggggtgcttctttgtgacagtatttttatttctgacattcattttatttgggtacatagtgtggttgttgataccttgcaatagtattgcttctgaaagtaataaaaaattttaggagaatttgagaagtttacagaattacttattcattgttttcttagtaagtcagtttaatgtttatttttctcattatttcatcactgcaataaagaataagggtgtttgagctcacctccatgcaaagacttcagttttaaaacattatttgcctaaaattagcattgtgatgctttctgaaagaaatattttataaatcctgtttaacagcagaatttctgaatgtgtagagactactacaaaattggaaaaagattggcaattctttgtaaagaatttgtgaattgtgtataaatttattctaacatttaataaaaatgtattttaaccta

SEQ ID NO: 167257 - DNA, 11589 bp, Homo sapiens
  Payload ID: 12910
  Gene Symbol: PKHD1
  Gene Name: polycystic kidney and hepatic disease 1 (autosomal recessive)
  Uniprot ID: P08F94
  ENST ID: ENST00000340994
  CDS Start-End: 262-10452
acaaacgagttaggtgagttatagtctaacgtgagtgagttacctgcgtggtggctgcaggctgagctctaaccagataacatgtccacggattcttgacagagagaaataagatcacttagaaagaaaggatcatttctcccttgagtcacaaggagacagaaacagaaaaaaaagcacaaaagctatgctgctccaatcaaaactgaaaatgcttttaatgtctgagcaatcttaagagtattgatttaagtggacagaatgactgcctggctgatctctctgatgagtattgaagtactacttttggcagtacgtcacctgagtttacatattgaacctgaagaaggtagccttgcagggggaacgtggatcacagtcatttttgatggtttggagttgggtgttctttaccccaacaatggctctcaattggagatacacctggtgaacgtgaacatggtggtgcccgcactgcggagtgttccctgtgacgtctttcctgttttcttggatttgcctgtggtgacatgccggaccagatctgtgctgtctgaagcacatgagggtctgtacttcctggaagcatacttcgggggacagctggtaagcagtccaaatccaggaccacgagatagctgtactttcaagttttccaaggcgcagacacccatcgttcaccaagtttatccaccaagtggtgttccaggaaaactaatacatgtatatggctggattatcactggaagattggaaacttttgattttgatgctgagtacattgatagcccagtgatcttggaagctcaaggagacaaatgggttactccttgctctcttataaataggcagatgggaagctgttatcctattcaggaggaccatggtcttgggactctgcagtgccatgtggaaggcgactacatcggctcccagaatgttagcttctcagtatttaacaaaggaaagtcaatggtccacaagaaggcatggctgatcagtgctaaacaggatcttttcctataccagacacactcagaaatattatctgtgtttccagaaactgggagccttgggggaagaacaaacatcacaattacaggagacttttttgacaattctgcccaggttaccattgcaggcattccatgtgatattagacacgtgtctcccaggaagattgagtgcaccactcgggctccaggaaaagatgtgaggctcaccacccctcagccaggcaatcgagggcttctttttgaagttggagatgctgttgagggactggaactgactgaagccaccccagggtacaggtggcagattgtccctaatgccagttctccatttgggttttggtcacaggaaggacaacctttcagagcacggctcagtgggttctttgtggctccagagacaaataattacactttctggattcaggcagatagccaagcttccttgcatttcagttggtcagaggaaccaaggactaaggtgaaagtggcctccatcagcgtcggcactgctgactggtttgactcctgggagcagaatagggatgaagggacctggcagcagaagactcccaagttggagctgttgggtggagccatgtactacctggaagcagagcatcatgggatagccccaagcagggggatgaggattggtgtccagattcacaacacctggctgaatcctgatgtggtcaccacttacctacgggagaagcaccagatccgagtccgagcccagaggcttccagaagtacaggtgctgaatgtatcaggcagaggaaacttcttccttacttgggacaatgtctctagtcagccaatccctgcaaatgccacagcccatctgattcaaacaaccattgaggagttacttgcagtaaaatgcaaactggaacccctttggtctaacatccttctccggcttggatttgaacgaggcccagaagtttccaactctgatggggacctcaccagtgggacggagcccttctgtggcaggttcagcctccgtcagcctcgacaccttgtccttactcccccggctgcccagaagggctatcggctagatcagtatacacacctgtgtcttgcatacaaaggccacatgaacaagatcctgaagatgattgtgtccttcacaatcggctttcaaaacatggtaaagaataccacctgtgactggagtctcacgaggaccagccccgagagctggcagttcgattgcactgacctctgggagacttgtgtgcgttgcttcggggatctccagccccctccggcaaactccccagtgctggttcatcagatcaaccttctccctctggcccaggagacgggcctgttctatgtggatgaaattattattgcagacacaaacgtaacagtttctcaagctgattctggaacggctcgcccagggggcaatctggtggaatcagtctctgtggtgggatcccctccggtctacagtgtcacctcctggctggcggggtgtggcacggagctcccgctcatcactgcacgctctgtgcccactgaaggaacagaagagggatctggactggtcctggtgacgacacagagacgacagcggacaagtccacctctaggaggacactttcgcatccagcttcctaatacagtgatttctgatgtccctgtacaaatttctgctcatcaccttcaccagctcttacagaataatgccgatgacttcacatccaggtacctcaatgccagtgacttcactgtgaaggaggatctatacacttgctacgaacacgtgtggaccttgtcctggtccactcagattggggatttgcccaattttatcagggtctctgatgaaaaccttactggagtgaatcctgctgcagccacgcgtgtggtatatgatggtggagtttttcttggacccatatttggagacatgttggctactgccaaccagcatactcaggtggttgtgcgagtgaatgatgtaccagctcattgcccaggttcctgctctttccagtacctccaagggtcaactccctgtgtccattctgtgtggtactccattgatggtgacatcaacctaatgatttacattaccggaactggtttctctggtgactcccagttcttgcaggttacagtgaacaaaacgagttgcaaagttattttctcaaaccagaccaatgtagtctgtcagacagatttgctacctgttggaatgcatcggatcttgatgttggtgagaccctctggtcttgccatcagtgccactggagaagacctcttcctaaatgtgaaacctagactggatatggtggagccttccagagctgcggatattggagggctctgggccaccatccgaggctctagtttggaaggtgttagcctgatattatttggatcttactcgtgtgccatcaatgtcgctacaagcaattcaagcagaattcagtgcaaagttccacccagggggaaagatggacgcattgtgaatgtgactgtgatcagaggggactattctgcagttcttcccagagcatttacatatgtctcttccttaaatccagttattgtgactctgagcagaaacataagcaatatagcaggcggtgagaccctggtcattggagtggcgaggctgatgaactatacggatttggatgtggaagtccacgtccaggatgccttggctccggttcacacacagtcggcttggggcctggaggtggcactgcccccactgccagctggtctccacagaatttccgtctctatcaatggggtcagcattcactcacaaggggttgatctccacatccagtacctcacagaagttttcagcatcgagccttgctgtgggtccctgctgggagggaccatcctcagcatctcaggaataggcttcagcagggacccagctttggtttgggtacttgtgggcaatcggtcctgtgacattgtgaacttaacggaggcgagcatctggtgtgaaaccctgccagccccccagatacccgatgcgggcgctcccactgttccagctgccgtggaggtctgggctggcaacaggttcttcgcccgtggtccttcaccaagcttggtggggaaaggcttcaccttcatgtatgaagcggcagcaacaccagtagtcactgccatgcaaggagaaatcacaaatagcagcctgagcctgcatgtgggaggaagtaacctctccaactcagtcatccttctggggaacctgaactgtgatgttgagacacagtccttccagggcaacgtgagcctgtctggatgctccatccctcttcacagtctggaggctggcatctatcctctccaagtacgtcagaagcagatgggatttgctaatatgtctgtggtgctccagcaatttgcagtgatgcctcggataatggccatcttcccatcgcagggttcggcatgtggtgggaccatacttactgtgagggggttgcttcttaactctagaaggaggtcagttcgggttgacctctcgggtccttttacttgtgtgattttgagtttgggagaccacaccattctctgccaggttagcctggagggtgaccccttgcctggagcttccttctccctgaacgtcacagtcctggtcaatgggctaaccagcgagtgtcaggggaattgcactcttttcataagggaagaggcaagtcctgtcatggatgccttgtccacaaacaccagtgggtctctgaccactgtgctgattaggggtcagaggttagccaccacagctgatgagccgatggtatttgtggatgatcaacttccttgcaatgtaactttttttaatgcaagccacgttgtgtgccagacaagagacttggccccaggaccccactacctgtcagttttttatacaagaaatgggtatgcttgttctggtaatgtttccagacacttctacattatgccccaagtgtttcattattttcctaagaatttcagcttacatggtggaagcctcttgaccatagagggcacaggcctgagaggacagaacaccacgtcagtctatattgaccagcagacctgcctgacggtgaacatcggtgctgagctcatccggtgcattgttcccacagggaatggctctgttgccctggaaatagaggtagatggactttggtatcacataggagtcattggttataacaaggcctttaccccagaattgatctctatttctcagagcgatgacatcttaacctttgcagtggcccagatctcaggagctgcaaacattgacatttttataggaatgtcaccctgtgtgggtgtctctggtaaccacaccgttcttcagtgcgtggtcccttcccttccggccggggagtaccacgtcagaggctatgactgcatcagagggtgggcctcatctgccctggtgttcacctcaagagttattattacagcagtgacggagaacttcggctgcctgggtggaaggctggtgcatgtgtttggagcgggattttctccagggaatgtctcagctgctgtgtgtggtgctccctgccgagtcctggctaatgctacagtgtctgccttcagctgcttggttctgcccctggatgtgtccttggccttcctgtgtggcctgaagcgtgaggaggacagctgtgaggctgccagacacacctatgtgcagtgtgatttgacagttgccatggcgacagagcaactgcttgaatcgtggccttacctctacatttgcgaggaaagttcccaatgcctctttgtgccagatcattgggcagagtcaatgtttccatcattctcgggcctctttatcagccctaaattggaaagagatgaagttctcatctataatagctcctgtaacattaccatggaaactgaggcagagatggagtgtgagacgcccaatcagccaattaccgtcaagattactgagatacggaaacgctggggccagaacactcagggcaacttttctttacagttctgccggagatggtccaggactcacagctggtttcctgaaaggctgccacaagatggcgacaacgtcacagtggagaatggccaattgcttctgctggacactaacacaagcatcctcaacttactgcacattaaagggggcaagctgattttcatggccccaggacccatcgagctcagggcacacgccatccttgtttctgatggtggagagctccggattggatccgaagacaagcccttccaaggcagagctcagatcacactctacgggagttcctactcaactcccttctttccctatggagtcaagttcctggctgtgaggaatggaactctttctctgcacggttcactaccagaagtaattgtcacctgtcttagagcaactgcccatgccctagacacagtgctggctttagaagatgctgtggactggaaccctggggatgaagttgtcatcatcagtggaacaggtgttaaaggtgccaaaccgatggaagagattgtcactgtggaaactgtgcaggatacagacctctatcttaagtcacctttgagatattctcacaactttacagagaattgggtggctggagagcaccatattttaaaggccactgtggctctgctcagcaggagtattaccatacaaggaaatctcactaatgagagggagaagctgcttgtttcatgccaggaggccaatgctccagaaggtaatctgcagcactgtttgtattccatgagtgagaagatgctaggatccagggatatgggagccagagtgatcgttcagtccttcccagaagagcccagccaggtccagttgaagggagtgcagtttcaagtcttggggcaagccttccataagcatctgagctcactcactctggtgggagctatgagagagtctttcatacagggctgcacagtgaggaactccttcagtagaggcctcagcatgtgcgggaccttgggcctgaaggtggacagtaatgtattctacaatattttaggtcatgcgctgctagttgggacatgcacggagatgagatatatctcctgggaggcaattcatggaaggaaagatgactggtcaggacatggaaatataataagaaacaacgtgatcatccaggtttctggtgccgagggactctccaatcctgaaatgttgacaccatctggcatctatatctgcagtcccaccaatgttatagaggggaacagagtgtgtggtgctggctatggctactttttccatctcatgaccaaccaaacatcacaagctccgcttctttccttcactcagaacattgcacattcttgtaccaggtatggtctctttgtataccctaaatttcagccaccttgggataatgtcactggcaccactctgttccagagcttcacagtttgggaaagtgcaggtggtgcccagatttttagaagtagcaatcttcgcctgaaaaacttcaaagtttattcatgcagagattttggaattgacgtcttggaaagtgatgcaaatacttcagttactgacagcttattacttggtcattttgcccacaagggaagtctgtgtatgtcatctgggattaaaactcctaaaagatgggaactgatggtgtctaacacaacctttgttaattttgatctcatcaactgtgtggccattagaacctgttcagactgttcccaaggacaaggtggatttactgtgaagaccagccagttgaagtttacaaactcttcaaacttagtggcatttccatttcctcatgcagcaattttggaagacttggatgggtctctgtctgggaaaaacagaagtcacattcttgcttctatggaaaccctttcagcttcttgtttggtcaattcaagctttggtcgggttgtccatggcagtgcctgtggaggaggtgttctttttcatcgtatgtctattggtttagcgaatactcctgaagtttcttatgatttaaccatgactgacagcagaaataaaacaaccactgtcaattatgtacgtgatacattgtctaaccctcgtggctggatggctctgctcttggaccaagagacctactcattgcaatctgagaacctttggatcaacagatctctgcagtactcagcaacctttgacaactttgctcctggtaattacctactgctggtgcacacagatttgccgccttaccctgacatcctcctaagatgtgggagtcgagtgggtctgtcttttccatttcttccatcaccaggtcagaaccaaggctgtgactggttcttcaatagccagctgaggcaactcacctatctggtttcaggtgaaggccaagttcaagtcattctccgggtgaaggaaggtatgcccccaactatttcagcttctacctctgcccctgaatcagctttaaaatggtccctccctgaaacatggcaaggtgttgaagaaggctggggaggatacaacaataccattccaggccctggggatgacgttctcattttacccaacagaactgtccttgtggatacagatcttccattcttcaaagggctgtatgtgatggggaccttagacttccctgtggacagaagcaatgttctgagtgtggcatgcatggtcattgcaggcggggagctgaaagttggtactttagaaaatcccttagaaaaggaacaaaagcttctgattctccttagagcctcagagggagtcttttgtgaccgtatgaatggaattcatattgacccaggaacaattggggtttatgggaaagttcatctttacagtgcttatcctaagaactcctggacacatcttggagctgatattgcctcaggaaatgagagaattatagtagaagatgcagtggattggcgcccccatgacaaaatagtccttagctcctcttcttatgagcctcatgaagcagaggtcctcactgtgaaagaagtcaagggccaccatgtgaggatctatgaacggctcaaacaccggcatattggaagtgtacatgtcacggaggatggccgacacattcgtttggctgctgaggttggactgttgacccgaaatatacaaattcagcctgacgtatcatgtagggggagactgtttgtggggtccttcaggaagtccagccgagaagaattttcaggtgtccttcaacttcttaatgtggaaattcagaacttcgggtcaccattgtactcatctgttgaattcagtaatgtgtcagcaggatcctggatcatatcatctactctgcaccagagctgtggcgggggcattcatgcagctgccagtcatggagtacttttaaatgacaatattgtgtttggcacagctggccatggcatagatttagagggtcaggcctatactgtcactaataaccttgtggttctgatgacacagccagcgtggtccaccatttgggtggcgggaatcaaagtgaaccaggtaaaggacatcaacctccatggcaacgttgtggcaggatcagagagacttggctttcacatccgaggccacaagtgctcctcttgtgaactgctttggtctgacaatgtggcgcattcaagtcttcatggccttcatctctataaggaaagtggacttgacaactgtaccagaatctctggcttcttggctttcaagaactttgactatggtgccatgttacatgtagagaacagcgtggagatagagaacattactctggtagacaatactattggtcttttggcagtagtgtatgtattttctgctccacaaaattccgtcaaaaaagtgcagattgtgcttaggaattcagtcattgtggccaccagctcttcttttgactgcattcaggacaaagtgaagccgcactcagccaacttgacatcaacagatagagctccctccaatccaagaggaggtcgaattggtattctgtggcctgtattcacctcagaaccaaatcagtggcctcaggagccatggcacaaagtgaggaatgatcattcaatttcaggaatcatgaaacttcaagatgttaccttttctagttttgtgaagagttgctatagcgatgacctggatgtctgcattctaccaaatgcagagaacagtggaattatgcacccaataacagcagagaggaccaggatgctaaagataaaagataaaaacaagttctactttccttcattacaacccaggaaagatttaggaaaagtagtctgtcctgaattagactgtgcaagtccaagaaaatatctcttcaaggatctggatgggagagccctgggtctgcctccaccagtttctgtatttcctaaaacagaggcagaatggactgcatccttcttcaacgcagtaaccactgagcaggctttgaagatttcagaatagaggaggagcctgcaggaagctgaactttgaaagattaatgaggcagcaggaagcagggtgaagaatgggttggagcatggaccaaatggaaagacttgttaagacactgtttcaattgttcaaattgagaagaaattgattgaggactgggaggagattgatggcagccagaatggagaggatggtacagatcaaagaaatacaaaagagaggaaatagagtttgcttactcctgactttggggactgtggagagggtgtcaacagtgacaccattgtccgtagtcaggatatctttgggaatggaagttccagtagcagatatgggggagtaggaaagaagaggatggttgcttaagctttgcctttagtgagtttggggtacccactatatgagagaggagcaattcagatattaaattggtggtgttgaaatctttggaattagagctttggagataaattgcagctagatataaattatctggaataaagtgataggtgaaataatatggtagagaagccttattttatttctctcttctttaccaattatattgagatattattattattggcatattaatatattattattggtatattaataatataataatataggtatattatcaataatatactaatactaatataccaataatagtgggttattgttaataatattggtaaagaaagaacataaatgtaagtttattaccaagaatattggtgtggtaaagataacccatttatgctggaggttgcaattttttgaattgcaaaatcagaccttggccatgaccttaagcagtaggatataaataactcccatgtgcccagtgttccattattggaacagtgtgccattcttgtgcactgatggaggaaatagttacagatacagtgtgatttgaggaattggttcccccagagccttattgaccctcaaatacttcccttacccatgttatcatttcctttctatcctaaaattgctacctttgctgccagatcttttccttcataaagtcaatgtgacatttactcatttattaactcatttcttcaacagatacttattgggcatttactgtatgccaagtattgtaataaatgctgtatgtacaaaatgaca

SEQ ID NO: 167258 - DNA, 16282 bp, Homo sapiens
  Payload ID: 12910
  Gene Symbol: PKHD1
  Gene Name: polycystic kidney and hepatic disease 1 (autosomal recessive)
  Uniprot ID: P08F94
  ENST ID: ENST00000371117
  CDS Start-End: 277-12501
acatttggctgggacacaaacgagttaggtgagttatagtctaacgtgagtgagttacctgcgtggtggctgcaggctgagctctaaccagataacatgtccacggattcttgacagagagaaataagatcacttagaaagaaaggatcatttctcccttgagtcacaaggagacagaaacagaaaaaaaagcacaaaagctatgctgctccaatcaaaactgaaaatgcttttaatgtctgagcaatcttaagagtattgatttaagtggacagaatgactgcctggctgatctctctgatgagtattgaagtactacttttggcagtacgtcacctgagtttacatattgaacctgaagaaggtagccttgcagggggaacgtggatcacagtcatttttgatggtttggagttgggtgttctttaccccaacaatggctctcaattggagatacacctggtgaacgtgaacatggtggtgcccgcactgcggagtgttccctgtgacgtctttcctgttttcttggatttgcctgtggtgacatgccggaccagatctgtgctgtctgaagcacatgagggtctgtacttcctggaagcatacttcgggggacagctggtaagcagtccaaatccaggaccacgagatagctgtactttcaagttttccaaggcgcagacacccatcgttcaccaagtttatccaccaagtggtgttccaggaaaactaatacatgtatatggctggattatcactggaagattggaaacttttgattttgatgctgagtacattgatagcccagtgatcttggaagctcaaggagacaaatgggttactccttgctctcttataaataggcagatgggaagctgttatcctattcaggaggaccatggtcttgggactctgcagtgccatgtggaaggcgactacatcggctcccagaatgttagcttctcagtatttaacaaaggaaagtcaatggtccacaagaaggcatggctgatcagtgctaaacaggatcttttcctataccagacacactcagaaatattatctgtgtttccagaaactgggagccttgggggaagaacaaacatcacaattacaggagacttttttgacaattctgcccaggttaccattgcaggcattccatgtgatattagacacgtgtctcccaggaagattgagtgcaccactcgggctccaggaaaagatgtgaggctcaccacccctcagccaggcaatcgagggcttctttttgaagttggagatgctgttgagggactggaactgactgaagccaccccagggtacaggtggcagattgtccctaatgccagttctccatttgggttttggtcacaggaaggacaacctttcagagcacggctcagtgggttctttgtggctccagagacaaataattacactttctggattcaggcagatagccaagcttccttgcatttcagttggtcagaggaaccaaggactaaggtgaaagtggcctccatcagcgtcggcactgctgactggtttgactcctgggagcagaatagggatgaagggacctggcagcagaagactcccaagttggagctgttgggtggagccatgtactacctggaagcagagcatcatgggatagccccaagcagggggatgaggattggtgtccagattcacaacacctggctgaatcctgatgtggtcaccacttacctacgggagaagcaccagatccgagtccgagcccagaggcttccagaagtacaggtgctgaatgtatcaggcagaggaaacttcttccttacttgggacaatgtctctagtcagccaatccctgcaaatgccacagcccatctgattcaaacaaccattgaggagttacttgcagtaaaatgcaaactggaacccctttggtctaacatccttctccggcttggatttgaacgaggcccagaagtttccaactctgatggggacctcaccagtgggacggagcccttctgtggcaggttcagcctccgtcagcctcgacaccttgtccttactcccccggctgcccagaagggctatcggctagatcagtatacacacctgtgtcttgcatacaaaggccacatgaacaagatcctgaagatgattgtgtccttcacaatcggctttcaaaacatggtaaagaataccacctgtgactggagtctcacgaggaccagccccgagagctggcagttcgattgcactgacctctgggagacttgtgtgcgttgcttcggggatctccagccccctccggcaaactccccagtgctggttcatcagatcaaccttctccctctggcccaggagacgggcctgttctatgtggatgaaattattattgcagacacaaacgtaacagtttctcaagctgattctggaacggctcgcccagggggcaatctggtggaatcagtctctgtggtgggatcccctccggtctacagtgtcacctcctggctggcggggtgtggcacggagctcccgctcatcactgcacgctctgtgcccactgaaggaacagaagagggatctggactggtcctggtgacgacacagagacgacagcggacaagtccacctctaggaggacactttcgcatccagcttcctaatacagtgatttctgatgtccctgtacaaatttctgctcatcaccttcaccagctcttacagaataatgccgatgacttcacatccaggtacctcaatgccagtgacttcactgtgaaggaggatctatacacttgctacgaacacgtgtggaccttgtcctggtccactcagattggggatttgcccaattttatcagggtctctgatgaaaaccttactggagtgaatcctgctgcagccacgcgtgtggtatatgatggtggagtttttcttggacccatatttggagacatgttggctactgccaaccagcatactcaggtggttgtgcgagtgaatgatgtaccagctcattgcccaggttcctgctctttccagtacctccaagggtcaactccctgtgtccattctgtgtggtactccattgatggtgacatcaacctaatgatttacattaccggaactggtttctctggtgactcccagttcttgcaggttacagtgaacaaaacgagttgcaaagttattttctcaaaccagaccaatgtagtctgtcagacagatttgctacctgttggaatgcatcggatcttgatgttggtgagaccctctggtcttgccatcagtgccactggagaagacctcttcctaaatgtgaaacctagactggatatggtggagccttccagagctgcggatattggagggctctgggccaccatccgaggctctagtttggaaggtgttagcctgatattatttggatcttactcgtgtgccatcaatgtcgctacaagcaattcaagcagaattcagtgcaaagttccacccagggggaaagatggacgcattgtgaatgtgactgtgatcagaggggactattctgcagttcttcccagagcatttacatatgtctcttccttaaatccagttattgtgactctgagcagaaacataagcaatatagcaggcggtgagaccctggtcattggagtggcgaggctgatgaactatacggatttggatgtggaagtccacgtccaggatgccttggctccggttcacacacagtcggcttggggcctggaggtggcactgcccccactgccagctggtctccacagaatttccgtctctatcaatggggtcagcattcactcacaaggggttgatctccacatccagtacctcacagaagttttcagcatcgagccttgctgtgggtccctgctgggagggaccatcctcagcatctcaggaataggcttcagcagggacccagctttggtttgggtacttgtgggcaatcggtcctgtgacattgtgaacttaacggaggcgagcatctggtgtgaaaccctgccagccccccagatacccgatgcgggcgctcccactgttccagctgccgtggaggtctgggctggcaacaggttcttcgcccgtggtccttcaccaagcttggtggggaaaggcttcaccttcatgtatgaagcggcagcaacaccagtagtcactgccatgcaaggagaaatcacaaatagcagcctgagcctgcatgtgggaggaagtaacctctccaactcagtcatccttctggggaacctgaactgtgatgttgagacacagtccttccagggcaacgtgagcctgtctggatgctccatccctcttcacagtctggaggctggcatctatcctctccaagtacgtcagaagcagatgggatttgctaatatgtctgtggtgctccagcaatttgcagtgatgcctcggataatggccatcttcccatcgcagggttcggcatgtggtgggaccatacttactgtgagggggttgcttcttaactctagaaggaggtcagttcgggttgacctctcgggtccttttacttgtgtgattttgagtttgggagaccacaccattctctgccaggttagcctggagggtgaccccttgcctggagcttccttctccctgaacgtcacagtcctggtcaatgggctaaccagcgagtgtcaggggaattgcactcttttcataagggaagaggcaagtcctgtcatggatgccttgtccacaaacaccagtgggtctctgaccactgtgctgattaggggtcagaggttagccaccacagctgatgagccgatggtatttgtggatgatcaacttccttgcaatgtaactttttttaatgcaagccacgttgtgtgccagacaagagacttggccccaggaccccactacctgtcagttttttatacaagaaatgggtatgcttgttctggtaatgtttccagacacttctacattatgccccaagtgtttcattattttcctaagaatttcagcttacatggtggaagcctcttgaccatagagggcacaggcctgagaggacagaacaccacgtcagtctatattgaccagcagacctgcctgacggtgaacatcggtgctgagctcatccggtgcattgttcccacagggaatggctctgttgccctggaaatagaggtagatggactttggtatcacataggagtcattggttataacaaggcctttaccccagaattgatctctatttctcagagcgatgacatcttaacctttgcagtggcccagatctcaggagctgcaaacattgacatttttataggaatgtcaccctgtgtgggtgtctctggtaaccacaccgttcttcagtgcgtggtcccttcccttccggccggggagtaccacgtcagaggctatgactgcatcagagggtgggcctcatctgccctggtgttcacctcaagagttattattacagcagtgacggagaacttcggctgcctgggtggaaggctggtgcatgtgtttggagcgggattttctccagggaatgtctcagctgctgtgtgtggtgctccctgccgagtcctggctaatgctacagtgtctgccttcagctgcttggttctgcccctggatgtgtccttggccttcctgtgtggcctgaagcgtgaggaggacagctgtgaggctgccagacacacctatgtgcagtgtgatttgacagttgccatggcgacagagcaactgcttgaatcgtggccttacctctacatttgcgaggaaagttcccaatgcctctttgtgccagatcattgggcagagtcaatgtttccatcattctcgggcctctttatcagccctaaattggaaagagatgaagttctcatctataatagctcctgtaacattaccatggaaactgaggcagagatggagtgtgagacgcccaatcagccaattaccgtcaagattactgagatacggaaacgctggggccagaacactcagggcaacttttctttacagttctgccggagatggtccaggactcacagctggtttcctgaaaggctgccacaagatggcgacaacgtcacagtggagaatggccaattgcttctgctggacactaacacaagcatcctcaacttactgcacattaaagggggcaagctgattttcatggccccaggacccatcgagctcagggcacacgccatccttgtttctgatggtggagagctccggattggatccgaagacaagcccttccaaggcagagctcagatcacactctacgggagttcctactcaactcccttctttccctatggagtcaagttcctggctgtgaggaatggaactctttctctgcacggttcactaccagaagtaattgtcacctgtcttagagcaactgcccatgccctagacacagtgctggctttagaagatgctgtggactggaaccctggggatgaagttgtcatcatcagtggaacaggtgttaaaggtgccaaaccgatggaagagattgtcactgtggaaactgtgcaggatacagacctctatcttaagtcacctttgagatattctcacaactttacagagaattgggtggctggagagcaccatattttaaaggccactgtggctctgctcagcaggagtattaccatacaaggaaatctcactaatgagagggagaagctgcttgtttcatgccaggaggccaatgctccagaaggtaatctgcagcactgtttgtattccatgagtgagaagatgctaggatccagggatatgggagccagagtgatcgttcagtccttcccagaagagcccagccaggtccagttgaagggagtgcagtttcaagtcttggggcaagccttccataagcatctgagctcactcactctggtgggagctatgagagagtctttcatacagggctgcacagtgaggaactccttcagtagaggcctcagcatgtgcgggaccttgggcctgaaggtggacagtaatgtattctacaatattttaggtcatgcgctgctagttgggacatgcacggagatgagatatatctcctgggaggcaattcatggaaggaaagatgactggtcaggacatggaaatataataagaaacaacgtgatcatccaggtttctggtgccgagggactctccaatcctgaaatgttgacaccatctggcatctatatctgcagtcccaccaatgttatagaggggaacagagtgtgtggtgctggctatggctactttttccatctcatgaccaaccaaacatcacaagctccgcttctttccttcactcagaacattgcacattcttgtaccaggtatggtctctttgtataccctaaatttcagccaccttgggataatgtcactggcaccactctgttccagagcttcacagtttgggaaagtgcaggtggtgcccagatttttagaagtagcaatcttcgcctgaaaaacttcaaagtttattcatgcagagattttggaattgacgtcttggaaagtgatgcaaatacttcagttactgacagcttattacttggtcattttgcccacaagggaagtctgtgtatgtcatctgggattaaaactcctaaaagatgggaactgatggtgtctaacacaacctttgttaattttgatctcatcaactgtgtggccattagaacctgttcagactgttcccaaggacaaggtggatttactgtgaagaccagccagttgaagtttacaaactcttcaaacttagtggcatttccatttcctcatgcagcaattttggaagacttggatgggtctctgtctgggaaaaacagaagtcacattcttgcttctatggaaaccctttcagcttcttgtttggtcaattcaagctttggtcgggttgtccatggcagtgcctgtggaggaggtgttctttttcatcgtatgtctattggtttagcgaatactcctgaagtttcttatgatttaaccatgactgacagcagaaataaaacaaccactgtcaattatgtacgtgatacattgtctaaccctcgtggctggatggctctgctcttggaccaagagacctactcattgcaatctgagaacctttggatcaacagatctctgcagtactcagcaacctttgacaactttgctcctggtaattacctactgctggtgcacacagatttgccgccttaccctgacatcctcctaagatgtgggagtcgagtgggtctgtcttttccatttcttccatcaccaggtcagaaccaaggctgtgactggttcttcaatagccagctgaggcaactcacctatctggtttcaggtgaaggccaagttcaagtcattctccgggtgaaggaaggtatgcccccaactatttcagcttctacctctgcccctgaatcagctttaaaatggtccctccctgaaacatggcaaggtgttgaagaaggctggggaggatacaacaataccattccaggccctggggatgacgttctcattttacccaacagaactgtccttgtggatacagatcttccattcttcaaagggctgtatgtgatggggaccttagacttccctgtggacagaagcaatgttctgagtgtggcatgcatggtcattgcaggcggggagctgaaagttggtactttagaaaatcccttagaaaaggaacaaaagcttctgattctccttagagcctcagagggagtcttttgtgaccgtatgaatggaattcatattgacccaggaacaattggggtttatgggaaagttcatctttacagtgcttatcctaagaactcctggacacatcttggagctgatattgcctcaggaaatgagagaattatagtagaagatgcagtggattggcgcccccatgacaaaatagtccttagctcctcttcttatgagcctcatgaagcagaggtcctcactgtgaaagaagtcaagggccaccatgtgaggatctatgaacggctcaaacaccggcatattggaagtgtacatgtcacggaggatggccgacacattcgtttggctgctgaggttggactgttgacccgaaatatacaaattcagcctgacgtatcatgtagggggagactgtttgtggggtccttcaggaagtccagccgagaagaattttcaggtgtccttcaacttcttaatgtggaaattcagaacttcgggtcaccattgtactcatctgttgaattcagtaatgtgtcagcaggatcctggatcatatcatctactctgcaccagagctgtggcgggggcattcatgcagctgccagtcatggagtacttttaaatgacaatattgtgtttggcacagctggccatggcatagatttagagggtcaggcctatactgtcactaataaccttgtggttctgatgacacagccagcgtggtccaccatttgggtggcgggaatcaaagtgaaccaggtaaaggacatcaacctccatggcaacgttgtggcaggatcagagagacttggctttcacatccgaggccacaagtgctcctcttgtgaactgctttggtctgacaatgtggcgcattcaagtcttcatggccttcatctctataaggaaagtggacttgacaactgtaccagaatctctggcttcttggctttcaagaactttgactatggtgccatgttacatgtagagaacagcgtggagatagagaacattactctggtagacaatactattggtcttttggcagtagtgtatgtattttctgctccacaaaattccgtcaaaaaagtgcagattgtgcttaggaattcagtcattgtggccaccagctcttcttttgactgcattcaggacaaagtgaagccgcactcagccaacttgacatcaacagatagagctccctccaatccaagaggaggtcgaattggtattctgtggcctgtattcacctcagaaccaaatcagtggcctcaggagccatggcacaaagtgaggaatgatcattcaatttcaggaatcatgaaacttcaagatgttaccttttctagttttgtgaagagttgctatagcgatgacctggatgtctgcattctaccaaatgcagagaacagtggaattatgcacccaataacagcagagaggaccaggatgctaaagataaaagataaaaacaagttctactttccttcattacaacccaggaaagatttaggaaaagtagtctgtcctgaattagactgtgcaagtccaagaaaatatctcttcaaggatctggatgggagagccctgggtctgcctccaccagtttctgtatttcctaaaacagaggcagaatggactgcatccttcttcaacgcaggtacatttagagaagaacagaaatgtacataccaatttctgatgcaaggattcatctgcaaacagactgaccaagtggtcctaattcttgatagcgctgatgccatttgggcaattcagaagttatatccagttgtatctgtgactagtggttttgttgatgtctttagcagtgtaaatgccaatattccctgctctacttctgggtcagtgtctactttctattctatcttacccatcaggcaaatcaccaaagtctgcttcatggatcaaactcctcaagttttgcgcttttttctattggggaacaaaagtacctccaagcttctcttggctgtattctaccatgagctccagagcccccacgtcttcttaggggaaagttttattccacccactctggttcagtcagcttccttattgctgaatgaatctattggtgccaactatttcaacatcatggataacctcttgtatgttgtcctacaaggagaggagcccattgaaatacgctcaggtgtttccattcacttggccctcactgtgatggtttcagtcttagaaaaaggctgggaaatagtaatactcgaaagactaactaacttcttacagattggccaaaaccaaatcaggtttattcacgagatgcctggccatgaagagaccttaaaggccattgctgacagtagagcaaaaagaaagcgcaattgccctactgtgacttgcactagtcattatagaagagttggtcaacgtaggcctctcatgatggaaatgaactcacatagggcttcacccccaatgactgtggaaactatctcaaaagtgattgtcattgaaattggtgattcgccaacagtaaggagcactggaatgatttcatccttatcaagtaacaaattacagaatttggctcatcgagtcatcactgctcaacagactggggtactagagaatgttctgaatatgactatcggggccttactagttactcagtcaaagggagtcattggctatggaaatacaagcagttttaaaactgggaacttgatatatattcggccctatgcactttccatcctagtccagccttcagatggagaagtgggaaatgagcttccagtgcagccacaattggtatttttggatgagcagaatcgaagagtagagtccctgggacctccttcagagccatggacaatttcagcttccctggaaggagcatcagactcagtgctaaaagggtgcacccaggcagaaactcaagatggttatgttagcttctacaacttggcagtcttgatctctgggtcaaactggcactttatttttactgtcacttctcctccaggagtcaattttacagctcgatccaagccatttgctgtcttgcctgtgactaggaaggagaagtcgaccatcatcctggctgcttccctgtcctctgtggcctcatggctggctctgagctgtctggtgtgctgttggcttaaaagaagcaaaagcagaaaaacaaaacctgaagagattcctgaatcccagactaataatcaaaatattcatatccacatctcatccaaacgccgagaatcacaagggcccaaaaaagaagacactgtggtgggagaagatatgagaatgaaggtcatgctgggcaaggtgaaccagtgcccccaccagttgatgaatggagtgtccagaaggaaagttagccgccacattgtccgagaggaagaggctgctgtgcctgctcctggtactactggcatcacatcccatgggcacatctgtgctccaggtgctcctgctcagcaggtgtacctgcaagagactgggaactggaaggagggccaagagcagttgctcagataccagctggcaggccaaaatcagctgctgctgctatgcccagacttcagacaagagaggcagcagttgccagggcaaagtcggctgagtaagcaaagtggcagcttggggctttcccaagagaagaaagcctcctgcggggccactgaggcattctgccttcattcagtacacccggaaactattcaggagcaactgtgatcagggaagttgggggcatttggcctgaaaggcagaatgttcccagtatttctggataataagctggggaagtgaggactgtcctgctgggacaactaagaagagagaatgtggactctgaatccctttttcaactttaaaatggaaaacagtcatataaatgcttacagactgaaaaatgtctcatacatattttgcagctatcatgatcctagttcaatgctaggcaaataatggcacttgttaattatttaccagtttttaacttaagcctgattttaacaacttgataatggtgtaatactgacttataccagcaggggttattattaagcattctctggattgaccacccacaatgctttgagcttcttttatagaagggatcatgaaaaggtctggtcagctacagtttaattccacactgttacagaaaagcatttctttatcctgtagtagcatttgaagggacagttcaacaccctgctccctgatctgtcagagcttaccttccaaccacaaggcaacttcctggctttttacaagtggattttatttcatggtttaaattcaatcattattgagaacctacagtagtgtgagcgtatcaaatttgcacttcatgaggatttacacatgaaaattgatattctcatgggctttgctgagagtttagttaaggacaaagatgtaaaaatgccaaatttgggaaaggaaattttgtatgaccactgttctatttttcagtgattctctctgttagtagctgggtcacatttacaactggaaaagaactacattgggagatcagagaaagccaagtggccaagtcctttatcaaaaagctgctttttggagaagatgatgcataaagctgtgatactaaggagaggagagattatgtcatatgcaactgctctaggctgtgcagggggtttaaatggagatcagaacaaaggctcacctggtattgatacatttggtaaggttgttaaaggcaatttcaccaaattcacacatttgtacggggcccatttcttttcaaactgaagaatactttaaacagcctgactgtgtccttggctctggatccagaaggccttatgctccaagcatgtaaagaaaagatcgcaggaatgtggagagcttccaaaaagagattgctctcagattttcctgaaaatcctgaaaaccaggattttccaatctctacaatgttaaggggttgttgtgtagttgcattggaagagagaaaggaaacacactctttcattgctgaattctaaataatgatgccctgaattagttctatgagaagtactggcagacagctgttatgtctgcagggcatcaaggggcaggtgtgtctcaccctactaagaattggcagaaatgttttaacctcttctttaggcatctggtgagtattgcagatcttcaggctgtccctaaaaggaggtaggtagccttctctgtggtcactgtgttggatttggaagaaaatataagtagatgttaaggtcagtgctctccaggagatttcaatccaggctatctgtgttcagggaatgatttgcaagaagttggtttatagacgtttactctggaggcacaagctggctgccatgctgagtaagtcctctttgtagatgatgtattttgcttgggcaccaacagaattaaaaacgaaaaacaaaaaaaaactcgaatgacttaggcagaacatgccttccctagtttaattagtccctgttataaccagttatttatctttttttgtagattctcggtcttgaagtcatttgcctttgcaatctctactttagtatactcattggatcctcaaagagccgtaagctttttggaaaaaaacatttcagaagtgaaggcttttgaggtttataaaatggtagcagtcttagtccttgccctgcctcagtttacctgcacatgctttctttcatttcctcggattctttcaccactttttaagttttttttccacaggtatttttcctgagctctataccatgcatttagctgcctagtgagaatatccagtaggttatcctatagttactatgaagttaacacagcccaaaaacctacttctccttgtgtttttttccaactcaatgaatgacatcactgcactcagaccagaaatctagaagtcagtcatgactcttcattctatttcgcccttcacaaagagttagctgccagctctgttatttctgccccttctttacccttcttccaatttttattatcttcttatttatcctctatgtgtcacaagaccagtctttctgggaggcatgttttatcctatccctctgcgtaggaataaccataattatcttactaattccatcccagaaaagcctgtgatccctgaggccagaattgactctttgggcctaaatagcagctataaacatcttcagtaacttgccaggctctagcatgtggcatggaattttggcatctagctaaaattcctcaacccatagttaagctactcctctttctcctaaaaaaaaaaaaaaatgagagaattagggaaacaccaaaagcaaagagagcagctctatgttcattcatgtctggagatgagccaatttgagcaccactgtaggccaactctaaatttattcagatcgttaacatgggtaacccagcaaatatttcccagcagtgacaatctacaccctttatctaaataaatattgagatgtgcttttttcctgtgttagttcaaagaatctcttcttgcctcccattgctgattttctgtattgatggactcatttctctcaagagattggacaagctaaaattctagagagttcaaaagtgtttgaaagtacattttaagtgttctcaccacaaaaaatgctagtgtgtgaggtgatacatatgttaattagttcaactgatccattccacaatgtatacatatttcaaactatcgagttgtacatgataaatatatacaatttttatttgtcaaataaagaacatctataaatatttatagatttcaaaattgagaaagaagtatatatggagccacggttgttttgaccatttctccatgctttttgtttggggagggggacattttttggggggcagggactgtgttcagggaaagtacctgaccaacagaacttcaagtctcttccagagtgcgagactcagcttatctgatcaaggtgaacttgcccttcaatagacttgcccttgttactgcccagtgaggccaccaaggaccaagaacagttgagctctctcagggccttcccctttcaacaatttagttgaatgactcccttccatctatcagtcttactccaaatatatgaaattactatacattgaaatgcctgcaaactatatgcaaaaatgagtatgaggaaatcaaatgtaaatcatatgcaaatattattcaaccaagcttctataaaattgtacgtgtcaataacagtaaagaattttaattaattctgtcatttaaaattcatgcattccatattttgctttcagaacttatagtctatgccaattttgaaaaaactataagcacaaggaattaaatactattgagtatagaactgttgatttcaacatacactatagcactttgactaattacagatatatttgatagaaaagtcacatttctacaaggtaattttcaaaaagaaataaaacatttctgtaaacttaaatgtggattaagtggcagaatacagagatttgaatgtttacaaat

SEQ ID NO: 167259 - DNA, 13076 bp, Homo sapiens
  Payload ID: 12911
  Gene Symbol: PKHD1L1
  Gene Name: polycystic kidney and hepatic disease 1 (autosomal recessive)-like 1
  Uniprot ID: Q86WI1
  ENST ID: ENST00000378402
  CDS Start-End: 105-12836
gggacgaagcgggcccgccagcgagtcgcagtcccaggagccgagctccagcactagagccagctgcgagcggagggcaccaactccgcagaactggcttttcaatgggacacctgtggctcctgggtatttggggcctctgtgggctgctcctgtgtgccgcggatcccagcacagatggctctcaaataatccccaaagtcacagaaataatacctaaatatggcagtataaatggagcaacaaggctgactataagaggggaaggtttttctcaagcaaaccagtttaactatggagttgataacgctgagttgggaaacagtgtgcaattaatttcttctttccagtcaattacttgtgatgtagaaaaagatgcaagtcattcaactcaaattacatgctatactagagcaatgccggaagattcctacactgttagagtcagtgtggacggggttcctgttacggaaaataacacctgcaaaggtcacatcaacagctgggaatgtaccttcaacgcaaaaagttttagaaccccaacaataagaagcatcacacctttatctggaactccaggtacactaataacaatccaaggcagaatcttcactgatgtctatggaagtaatattgcactaagctcaaatgggaaaaatgttaggattttgagagtttacattggaggaatgccctgtgagcttctcataccacaatctgataatttatatggtctaaaactggatcatccaaatggagatatgggttctatggtttgtaagacgactggaacttttattggtcatcacaatgtcagcttcatcttagataatgattatggaaggagttttccacagaaaatggcatattttgtttcttctctcaataaaattgcaatgtttcaaacatatgcagaggtcaccatgattttcccttcacaaggaagcattcgaggtggcaccacgctgacaataagtgggcgtttctttgatcagacagatttccccgtcagagttctagttggaggtgaaccttgtgatattttgaatgtcacagaaaatagtatatgttgcaagacaccccccaaacctcatattctcaaaactgtatatccaggagggagaggcctgaagcttgaggtgtggaataatagccgtccaatacgtttggaagagatactggaatacaatgaaaaaacgcctgggtacatgggtgccagttgggtagattcagcttcctatatttggctcatggaacaagacacatttgttgcacgctttagtggatttttggtggctccagattctgatgtttatagattctacatcaagggtgatgaccgttatgctatttattttagccagactggacttccagaagataaggtgaggattgcatatcattctgctaatgccaacagttatttttccagtccaacacaaagatcagatgatattcatctgcagaaaggaaaagaatactatattgaaatcttgctgcaggagtacagattaagtgcatttgttgatgttggactgtaccagtatcgaaatgtttatactgaacaacaaacaggagatgcagtgaatgaagaacaagttatcaaatcccagtcgacaatcctccaggaagtacaggttataacattggaaaactgggaaacaactaatgcaattaatgaggttcagaagatcaaggtaaccagcccatgtgtggaagctaattcatgttcactttaccaatatagattaatctataatatggaaaaaactgtcttcctacctgctgatgcttctgaattcatactgcaatcagccttgaatgacctctggtctataaaaccggacacagttcaagtaataagaacacaaaatccccagagctatgtctacatggtaacattcatatcaactagaggagactttgatctgcttggttatgaagtagttgaagggaataatgtcacactggatattacagaacaaaccaaaggaaaacccaacttggagacattcacactgaattgggatgggatcgcttctaagccactcactctatggtcatcagaagctgaatttcagggagcagtggaagaaatggttagcactaagtgtccaccacaaattgcaaattttgaagaaggatttgttgtgaaatatttcagagactatgaaactgattttaatctggaacatattaacagagggcagaagacagctgaaaccgatgcttactgtggtcgttattccctgaaaaacccagctgttctttttgactcagcagatgttaaaccaaacagacgaccatatggagatattttattgtttccttataatcagttatgtttagcatacaaaggattcctggcaaattatattggtctaaaatttcagtaccaagacaatagcaagattactagaagcactgatacacagtttacatacaactttgcttatggaaacaactggacttacacttgcatagaccttctggatctcgtaagaacgaaatacactgggacaaatgtttctcttcagaggattagcttacataaagcatcagaatcacagtccttctatgtggatgtagtgtacattggacacacatctacaatctcaacattggatgaaatgcccaagagaagacttcctgcattagcaaataaaggaatattcttagagcactttcaggtgaatcagaccaaaacaaatgggccaactatgacaaaccaatattctgttaccatgacttcatacaattgcagttacaatatacccatgatggctgtgagctttgggcagataatcacacatgagacagagaacgagtttgtctacagaggaaataattggccaggcgagtcaaaaattcatattcaaagaattcaagctgcatctccacctctaagtggcagctttgacattcaagcttatggacatattcttaaaggcctccccgctgctgtgtcagctgcagatctgcagtttgcactccagagtctggagggaatgggaagaatctcagttacacgagagggaacctgtgctggctacgcgtggaacatcaaatggagaagcacctgcggaaagcagaatcttctacagattaatgattccaacattattggagaaaaggctaatatgacagttacaaggataaaggaaggtggcttattcagacaacatgtacttggagacctacttcgtacacccagtcaacagccacaggttgaagtctatgtcaatggaattccagctaaatgttcaggtgactgtggatttacatgggattccaacattactcccctagtcttggcgataagcccttctcaagggtcctatgaagaaggcacaattctaaccatagtgggttctggattttctcctagttcagctgtaacagtctcagttggaccagtaggttgttctcttctttctgtggatgaaaaagagctcaagtgccagattctgaatggaagtgctggacatgcccccgttgctgtgtccatggctgatgttggactagcacagaatgtagggggtgaagagttctactttgtttatcagagtcagatctcacatatctggcctgattctggaagcatagcaggtggtactctactgactttatctggatttggctttaatgaaaattcaaaggtattagttggaaatgaaacctgcaatgtgattgaaggggatttgaataggataacctgcaggacaccaaaaaaaactgagggtacagttgatatttcagttactaccaatggatttcaagccacagcaagggatgcttttagttataattgtttacagacaccaattataactgattttagtccaaaagtacgaacaatactaggagaagttaatttaacaattaagggctataattttggaaatgaactcacacaaaacatggcggtgtatgttggaggaaaaacctgccagattcttcactggaacttcacagatattagatgccttttgcccaagttgtctcctggaaaacatgatatctatgtagaagtcagaaactggggttttgcatcaacaagagacaaattaaattcttcaatacagtatgttttagaagtgaccagcatgtttccacaaagaggctccttgtttggtggaactgaaatcaccataaggggttttggattcagcacaataccagctgagaataccgtgctgttagggtccatcccttgcaatgttacatcatcatcagaaaatgtcataaaatgtattcttcattcaactgggaatatattcaggattaccaacaatgggaaagattcagtacatggattaggttatgcctggtcaccaccagtcctaaatgtgtctgtgggggacacagtggcatggcattggcaaacacatccgtttcttagagggataggatataggattttttctgtctccagtcctggaagtgtaatttatgatggcaaaggattcacaagtggaagacaaaaatctacatcaggttcattttcttaccaatttacttctcctggaatccattattatagcagcgggtatgttgatgaggctcactccatttttctccaaggagtcattaatgttttaccagctgaaaccagacacattcccttgcacctgtttgtgggtcgctctgaagccacatatgcttatggaggacctgagaatttgcacttgggaagctctgtggcaggctgcctagcaacagaacccctgtgcagcctgaacaataccagggttaaaaattcaaaaagattgctatttgaggtttcaagttgtttttcaccatctataagcaacattactccgtccactggaacagtaaatgaactaataacaattattggacatggctttagtaatctcccatgggctaataaggttacaattggtagctacccctgtgtcgtagaagaaagtagtgaggattcaattacatgtcatattgaccctcaaaactcaatggatgttggtatcagggaaactgtcactttgactgtctacaacctgggcactgctatcaatacgttgtccaatgaatttgataggcgatttgtacttttgccaaacattgacctggtgttgccaaatgcaggatcaactacaggaatgacaagcgtgaccataaaaggctctggatttgccgtttcttctgcaggtgtaaaagtccttatgggtcatttcccatgtaaagttctatcagtgaattatacggccattgaatgtgaaacatcccctgctgcccaacagcttgtggatgtagatcttctaatacatggagtgcctgcccagtgccagggaaactgcaccttttcatacttagaaagcatcactccttacataacaggagtcttcccaaactctgtcataggatctgtaaaagttcttattgaaggagaaggtttggggactgttttggaggacattgctgttttcattggaaatcaacagttcagagcaatagaggttaatgaaaacaacatcactgctcttgtgactcctctcccagttggacatcattctgttagtgttgtggtgggaagtaaaggcttggctctgggaaacctgactgtcagcagccccccagtagcatctctatcaccaacttctggaagcattggtggtggaactacactggtgatcacaggaaatggcttctatccaggcaacactacagtcactattggggatgaaccttgtcaaattatttccatcaaccccaatgaagtctactgccgcactcccgctgggaccactggaatggtcgatgttaaaatctttgttaatacaattgcttatccacctttgctttttacatatgccctggaggatactccatttctcagaggaattatcccaagcagaggtccaccaggaactgaaattgagatcactggatccaactttggctttgagatcttggaaatctccgtgatgataaataacattcagtgtaatgtaaccatggccaatgatagtgtggtgcagtgcatcgtgggagatcatgctgggggcacatttcctgttatgatgcatcataagacaaaaggctcagccatgtccacagttgtatttgagtacccgcttaatattcaaaatattaatccaagccaagggagctttggtgggggtcaaaccatgactgtgacaggcaccggatttaatccacaaaattcaattatattagtttgtggctcagaatgtgcaattgacaggcttagatctgattacacaacactattatgtgaaattccatctaataatggcacgggagctgagcaagcctgtgaagtgagtgtggttaatgggaaagatttgtcacagtccatgactccgtttacgtacgcagtgtcactgactccactcatcactgcagtatctcctaagagaggcagtacagcagggggcaccagactgacagtcgtgggatcaggattcagtgaaaatatggaggatgttcatatcaccatagctgaagccaaatgtgatgttgagtattccaacaagacacacatcatctgcatgacagatgcccatactctatcagggtgggctccagtttgtgtccacatcagaggtgtcggcatggccaaactggataatgctgactttctttatgttgatgcctggtcctccaatttctcatgggggggaaaatctcccccagaagaaggatctcttgttgttattacaaaaggacagaccattctgctggatcaaagcacccctattttgaaaatgttgcttattcagggtgggactctaatatttgatgaagctgacattgaactccaggcagaaaatattctaattacagatggaggtgttcttcagattggaacagagacatccccattccaacacaaggctgtcattaccttgcatggtcacctgcgatctcctgagctccctgtctatggtgccaaaacactggctgtgcgggagggaatcctggatctgcacggtgtgcctgttcctgtgacctggactcgcttggctcatactgcaaaggcaggggaaagaattttaattttacaagaagcagtaacatggaaaccaggagataacattgtaattgcaagcacaggacacagacacagtcaaggagagaatgaaaaaatgaccattgcatctgtgtctgctgatggcataaacataacactaagtaacccactaaattacacacacttaggaattacggtcacactccctgatggaactctgtttgaagcaagagcagaagttggaattcttacaagaaatattttaataagaggatctgataatgttgagtggaataacaaaattcctgcatgtcctgatggatttgacacaggagaatttgctacacagacctgtctccaaggaaagtttggagaagaaataggaagtgaccaatttggaggctgcgttatgtttcatgctcctgtacctggtgctaacatggtaactgggagaatagaatatgtagaggtattccatgctggccaggctttccggttggggcgatatccaatacattggcacctgcttggagacttacagtttaaatcttatgtaagaggctgtgcaattcaccaggcctataacagagctgttactattcataacacacaccatcttctggttgagaggaatattatatatgatattaagggaggagcattttttatagaagatggtattgaacatggcaatatcctccagtataacttggcagtatttgtacagcaaagtaccagtcttctgaatgatgatgtgaccccggctgcattttgggtcaccaacccgaacaataccatacgacacaatgctgttgctggtggcactcactttggcttttggtaccggatgaacaaccaccctgatgggccatcctatgacagaaacatttgtcaaaaaagagttccccttggcgaattttttaacaatactgtccattctcaaggttggtttggaatgtggatctttgaggaatatttccccatgcaaacgggatcttgtacatctacagtgcctgcacctgcaatatttaactcacttactacttggaattgtcaaaaaggagctgaatgggtcaatggaggtgcccttcagttccataactttgtgatggtgaataactatgaggctggaattgagactaagaggatcctggctccttatgttggagggtggggtgaaaccaatggagcggtgattaaaaatgccaaaatagtcggccatcttgatgaactgggaatggggtctgcattttgcacagcaaaaggcctggttctcccatttagtgaaggcttgactgtctcttctgtgcactttatgaactttgaccgtcccaactgtgtagctttgggagtgacatccatctctggagtttgtaatgacagatgtgggggttggagtgcaaagtttgttgacgtccagtattctcacacaccgaacaaggctggctttcgctgggaacatgaaatggtaatgattgatgttgatggctcacttacagggcacaaaggacataccgtcattccacacagctcattgctagacccttctcattgtactcaggaagctgagtggagcattgggttccctggatcagtctgtgatgcttcagtcagctttcaccgtttagcgttcaaccagccttctccagtatctctgcttgaaaaggatgtggttctttcagactcttttggcacaagcattattccatttcagaagaaacgactgactcatatgtctggatggatggctctgattccaaatgcaaatcacattaactggtattttaaaggtgtggatcacataaccaacatttcatatacatcgacattctatggattcaaggaagaagactatgtaattatatcacataacttcactcaaaatcctgacatgtttaatattattgatatgaggaatggttcctcaaatccattgaattggaatactagcaagaatggggactggcaccttgaagcaaacactagtactctatattacttggtgtcaggaagaaatgaccttcatcagagtcagctcatttctgggaacctggatcctgatgtgaaagacgttgttattaatttccaagcttactgttgtattctccaggattgctttcctgtacatccgccatcaagaaaaccaattcccaagaagcgaccagccacatataatttatggtcaaatgattctttttggcaatcatcacgagaaaataattatactgtacctcacccaggggcaaatgtgattatacctgaaggaacatggattgtagctgacatagatatgccatcaatggaaagactcattatttggggggttctagaactggaagataaatacaatgtaggagctgcagaatcttcttacagagaagttgttttgaatgctacctacatatcactgcagggaggtagattaatcggtggctgggaagataacccttttaaaggagacttaaagattgttcttagaggaaatcatactacacaagactgggctcttccagaaggaccaaatcaaggggcaaaggtcttaggggtgtttggtgagctggatcttcatggaattccacattcaatatataaaactaagctctcagaaactgcatttgcaggttccaaagtcctgtctctgatggatgctgtggattggcaggagggagaagagattgtgataacaaccacaagctacgatttccaccagacagaaacaagaagtatcgttaaaatcctgcatgatcataaaattctcattcttaatgatagcctttcctatactcactttgctgaaaaataccatgtccctggaactggtgagagctacacgttagcagctgatgttgggatactgagtaggaacatcaaaatagttggtgaagattaccccggttggtctgaggactcttttggagcacgcgtactggttggctcattcactgaaaatatgatgacatttaaaggaaatgcaagaataagtaatgtggaattttatcacagtggtcaagaaggcttcagggatagcacagatccaagatatgctgtaacgtttcttaacctaggacagattcaagaacatggctcatcttatattcgaggctgtgcttttcaccatggcttctctccagcaattggtgtatttgggacagatggattggacatagatgacaacatcattcactttacagtgggggaaggcataagaatatgggggaatgccaaccgagtccgagggaatttgattgcactttcggtttggccaggaacctatcagaacagaaaagatttaagttcaactctctggcatgcagcaattgagataaatagagggaccaatacagttttacagaataatgtagtggctggatttggaagagcaggataccgcattgatggtgaaccttgcccaggccagtttaatcctgtggaaaagtggtttgacaatgaagcccatggaggtttatatgggatctatatgaaccaagatggccttcctggatgttctcttatacaaggatttaccatttggacatgctgggattatggaatttattttcagaccacagagagtgtgcacatttataatgtgaccctggttgacaatggaatggccatttttccaatgatttacatgccagctgctatatcacacaaaatttccagtaaaaatgtacaaattaagagctcattaattgttggaagtagccctgggtttaattgctctgatgtcctaactaatgatgatcctaatattgaactcactgctgctcatcggagtcctagatctccatcaggtgggagaagtgggatttgttggcctacctttgcttcagctcataacatggcaccccgaaagccccatgcaggaatcatgagttacaatgccatcagtggccttttggacatctcaggttcaacatttgttggatttaagaatgtttgttcaggggaaactaatgttatattcattactaaccctttaaatgaggatttacagcatccaatccatgtgaagaatataaaactggttgataccactgaacaatcaaaaatatttatacataggcctgatataagtaaggtcaatccatctgattgtgtagacatggtttgtgatgccaagaggaaatcttttcttagagacatagatggctcctttctggggaatgctggttctgtgatacctcaagcagaatatgaatgggacggaaacagccaagtaggaattggagactacagaattcctaaggcgatgctcacattcttgaatggaagtagaattcctgtcactgagaaagcacctcataaaggaattattagagattcaacctgtaagtaccttccagagtggcagagctatcagtgctttgggatggaatatgcaatgatggttattgaaagtctggatcctgacacagaaactcgaagactttccccagtggctataatgggcaacggttatgttgatcttattaatggcccacaggatcatggctggtgtgctggatatacatgccagagaaggctgtccctgtttcacagcattgtggctctgaacaaatcttatgaagtttacttcactggcaccagtcctcagaatcttcgactgatgttgcttaatgttgatcataacaaggctgttctagtaggaattttcttttccacacttcaacgtttggatgtctatgtgaacaacttattggtctgtccaaaaactacaatatggaatgcccagcagaaacactgtgaacttaataaccatctgtacaaagaccaattccttcctaacctggattccactgtccttggtgaaaactactttgatggaacctaccagatgctttatcttttggttaaaggaactatacctgttgaaattcacactgccacagtgatatttgtttctttccaattatctgttgcaacagaagatgacttttatacctctcacaatctggttaaaaatcttgccttgttcctaaagataccaagtgacaaaatccgtatcagcaaaataagagggaagagtctgaggaggaagagatccatgggattcataattgaaatagagattggagaccctcctattcagttcataagcaatggcaccacaggtcagatgcagttatctgaactccaggaaattgctggttctcttggacaagctgtaattttaggaaacatcagtagtatccttggatttaacatttcgtccatgtctattactaatcccctccccagcccaagtgactctgggtggattaaggtgactgcccagccagttgaaaggtctgcatttcctgttcatcacgtggccttcgtgtcctcactcttagtgatcactcagccggtggcagcacagccaggacagccatttcctcagcagccttcggtaaaggcaacagattctgacggtaactgtgtatcagttggaattactgcactaactttgagggccatactcaaggactccaataataaccaagtcaatggccttagtggaaatacaacaattccgtttagcagctgttgggccaactacacagaccttactccccttagaacaggaaaaaattataagattgaatttatactggataatgttgttggggtagaatccagaactttcagcctgctggcagagtctgtctctagcagtggcagcagcagcagcagcaacagcaaagcatcaactgtgggtacatatgcccagataatgactgtagtaattagctgtctggttggaagaatgtggctcttggaaatatttatggctgcagtttcaactttgaatataactttaagaagctactaaagtgctgttccgaagaataggctgaaacaaaaatataagaattattagctactttgttgggcaataggcaaaagtctatagcattttcatgaaaatatactaaaaatatttttatgatatataaaatgtactaattagctttaaacactaaaatcagatttcttcaaaatataaatttgttttgattctttatatttatatgtttttatttcatttcaataaacttccagaaatttgtca

SEQ ID NO: 167260 - DNA, 3686 bp, Homo sapiens
  Payload ID: 12911
  Gene Symbol: PKHD1L1
  Gene Name: polycystic kidney and hepatic disease 1 (autosomal recessive)-like 1
  ENST ID: ENST00000526472
  CDS Start-End: 1-3516
aagcaagagaaaataaatcaaaatgttacagttattcggaacaatccccacattccttgtaaaccccagatggtcttgaacctgtaccagcttaatcagctcgattgtcctggaggtagattaatcggtggctgggaagataacccttttaaaggagacttaaagattgttcttagaggaaatcatactacacaagactgggctcttccagaaggaccaaatcaaggggcaaaggtcttaggggtgtttggtgagctggatcttcatggaattccacattcaatatataaaactaagctctcagaaactgcatttgcaggttccaaagtcctgtctctgatggatgctgtggattggcaggagggagaagagattgtgataacaaccacaagctacgatttccaccagacagaaacaagaagtatcgttaaaatcctgcatgatcataaaattctcattcttaatgatagcctttcctatactcactttgctgaaaaataccatgtccctggaactggtgagagctacacgttagcagctgatgttgggatactgagtaggaacatcaaaatagttggtgaagattaccccggttggtctgaggactcttttggagcacgcgtactggttggctcattcactgaaaatatgatgacatttaaaggaaatgcaagaataagtaatgtggaattttatcacagtggtcaagaaggcttcagggatagcacagatccaagatatgctgtaacgtttcttaacctaggacagattcaagaacatggctcatcttatattcgaggctgtgcttttcaccatggcttctctccagcaattggtgtatttgggacagatggattggacatagatgacaacatcattcactttacagtgggggaaggcataagaatatgggggaatgccaaccgagtccgagggaatttgattgcactttcggtttggccaggaacctatcagaacagaaaagatttaagttcaactctctggcatgcagcaattgagataaatagagggaccaatacagttttacagaataatgtagtggctggatttggaagagcaggataccgcattgatggtgaaccttgcccaggccagtttaatcctgtggaaaagtggtttgacaatgaagcccatggaggtttatatgggatctatatgaaccaagatggccttcctggatgttctcttatacaaggatttaccatttggacatgctgggattatggaatttattttcagaccacagagagtgtgcacatttataatgtgaccctggttgacaatggaatggccatttttccaatgatttacatgccagctgctatatcacacaaaatttccagtaaaaatgtacaaattaagagctcattaattgttggaagtagccctgggtttaattgctctgatgtcctaactaatgatgatcctaatattgaactcactgctgctcatcggagtcctagatctccatcaggtgggagaagtgggatttgttggcctacctttgcttcagctcataacatggcaccccgaaagccccatgcaggaatcatgagttacaatgccatcagtggccttttggacatctcaggttcaacatttgttggatttaagaatgtttgttcaggggaaactaatgttatattcattactaaccctttaaatgaggatttacagcatccaatccatgtgaagaatataaaactggttgataccactgaacaatcaaaaatatttatacataggcctgatataagtaaggtcaatccatctgattgtgtagacatggtttgtgatgccaagaggaaatcttttcttagagacatagatggctcctttctggggaatgctggttctgtgatacctcaagcagaatatgaatgggacggaaacagccaagtaggaattggagactacagaattcctaaggcgatgctcacattcttgaatggaagtagaattcctgtcactgagaaagcacctcataaaggaattattagagattcaacctgtaagtaccttccagagtggcagagctatcagtgctttgggatggaatatgcaatgatggttattgaaagtctggatcctgacacagaaactcgaagactttccccagtggctataatgggcaacggttatgttgatcttattaatggcccacaggatcatggctggtgtgctggatatacatgccagagaaggctgtccctgtttcacagcattgtggctctgaacaaatcttatgaagtttacttcactggcaccagtcctcagaatcttcgactgatgttgcttaatgttgatcataacaaggctgttctagtaggaattttcttttccacacttcaacgtttggatgtctatgtgaacaacttattggtctgtccaaaaactacaatatggaatgcccagcagaaacactgtgaacttaataaccatctgtacaaagaccaattccttcctaacctggattccactgtccttggtgaaaactactttgatggaacctaccagatgctttatcttttggttaaaggaactatacctgttgaaattcacactgccacagtgatatttgtttctttccaattatctgttgcaacagaagatgacttttatacctctcacaatctggttaaaaatcttgccttgttcctaaagataccaagtgacaaaatccgtatcagcaaaataagagggaagagtctgaggaggaagagatccatgggattcataattgaaatagagattggagaccctcctattcagttcataagcaatggcaccacaggtcagatgcagttatctgaactccaggaaattgctggttctcttggacaagctgtaattttaggaaacatcagtagtatccttggatttaacatttcgtccatgtctattactaatcccctccccagcccaagtgactctgggtggattaaggtgactgcccagccagttgaaaggtctgcatttcctgttcatcacgtggccttcgtgtcctcactcttagtgatcactcagccggtggcagcacagccaggacagccatttcctcagcagccttcggtaaaggcaacagattctgacggtaactgtgtatcagttggaattactgcactaactttgagggccatactcaaggactccaataataaccaagtcaatggccttagtggaaatacaacaattccgtttagcagctgttgggccaactacacagaccttactccccttagaacaggaaaaaattataagattgaatttatactggataatgttgttggggtagaatccagaactttcagcctgctggcagagtctgtctctagcagtggcagcagcagcagcagcaacagcaaagcatcaactgtgggtacatatgcccagataatgactgtagtaattagctgtctggttggaagaatgtggctcttggaaatatttatggctgcagtttcaactttgaatataactttaagaagctactaaagtgctgttccgaagaataggctgaaacaaaaatataagaattattagctactttgttgggcaataggcaaaagtctatagcattttcatgaaaatatactaaaaatatttttatgatatataaaatgtactaattagctttaaacactaaaatcagatttcttcaaaat

SEQ ID NO: 167261 - DNA, 14138 bp, Homo sapiens
  Payload ID: 12912
  Gene Symbol: PKD1
  Gene Name: polycystic kidney disease 1 (autosomal dominant)
  Uniprot ID: P98161
  ENST ID: ENST00000262304
  CDS Start-End: 210-13121
gcactgcagcgccagcgtccgagcgggcggccgagctcccggagcggcctggccccgagccccgagcgggcgtcgctcagcagcaggtcgcggccgcagccccatccagccccgcgcccgccatgccgtccgcgggccccgcctgagctgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctagacgtctcccacaacctgctccgggcgctggacgttgggctcctggcgaacctctcggcgctggcagagctggatataagcaacaacaagatttctacgttagaagaaggaatatttgctaatttatttaatttaagtgaaataaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccggccccccgccacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggagcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtcaccctccacggccaggatgtcctcatgctccctggtgacctcgttggcttgcagcacgacgctggccctggcgccctcctgcactgctcgccggctcccggccaccctggtccccgggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggctgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtggacctttggggatggggagcaggccctccaccagttccagcctccgtacaacgagtccttcccggttccagacccctcggtggcccaggtgctggtggagcacaatgtcatgcacacctacgctgccccaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtgcgggggctcgtcgtcaatgcaagccgcacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtgctcgaggccggcacctaccatgtgcagctgcgggccaccaacatgctgggcagcgcctgggccgactgcaccatggacttcgtggagcctgtggggtggctgatggtggccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcaggtgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgagcaggcctttgttggacagatgaagagtgacttgtttctggatgattctaagagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcagatgaagacctgatccagcaggtccttgccgagggggtcagcagcccagcccctacccaagacacccacatggaaacggacctgctcagcagcctgtccagcactcctggggagaagacagagacgctggcgctgcagaggctgggggagctggggccacccagcccaggcctgaactgggaacagccccaggcagcgaggctgtccaggacaggactggtggagggtctgcggaagcgcctgctgccggcctggtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcggagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtctgaggagctctggccatggatggcccacgtgctgctgccctacgtccacgggaaccagtccagcccagagctggggcccccacggctgcggcaggtgcggctgcaggaagcactctacccagaccctcccggccccagggtccacacgtgctcggccgcaggaggcttcagcaccagcgattacgacgttggctgggagagtcctcacaatggctcggggacgtgggcctattcagcgccggatctgctgggggcatggtcctggggctcctgtgccgtgtatgacagcgggggctacgtgcaggagctgggcctgagcctggaggagagccgcgaccggctgcgcttcctgcagctgcacaactggctggacaacaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaaggctgcccagcagctacgcttcgtgcgccagtggtccgtctttggcaagacattatgccgagctctgccagagctcctgggggtcaccttgggcctggtggtgctcggggtagcctacgcccagctggccatcctgctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggagttccgccacaaagtccgctttgaagggatggagccgctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggccagcactgcccagccgccttgcccgggccagtcggggtgtggacctggccactggccccagcaggacaccccttcgggccaagaacaaggtccaccccagcagcacttagtcctccttcctggcgggggtgggccgtggagtcggagtggacaccgctcagtattactttctgccgctgtcaaggccgagggccaggcagaatggctgcacgtaggttccccagagagcaggcaggggcatctgtctgtctgtgggcttcagcactttaaagaggctgtgtggccaaccaggacccagggtcccctccccagctcccttgggaaggacacagcagtattggacggtttctagcctctgagatgctaatttatttccccgagtcctcaggtacagcgggctgtgcccggccccaccccctgggcagatgtcccccactgctaaggctgctggcttcagggagggttagcctgcaccgccgccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacacctgctgcgcttggtaggtgtggtggcgttatggcagcccggctgctgcttggatgcgagcttggccttgggccggtgctgggggcacagctgtctgccaggcactctcatcaccccagaggccttgtcatcctcccttgccccaggccaggtagcaagagagcagcgcccaggcctgctggcatcaggtctgggcaagtagcaggactaggcatgtcagaggaccccagggtggttagaggaaaagactcctcctgggggctggctcccagggtggaggaaggtgactgtgtgtgtgtgtgtgtgcgcgcgcgcacgcgcgagtgtgctgtatggcccaggcagcctcaaggccctcggagctggctgtgcctgcttctgtgtaccacttctgtgggcatggccgcttctagagcctcgacacccccccaacccccgcaccaagcagacaaagtcaataaaagagctgtctgactgc

SEQ ID NO: 167262 - DNA, 14135 bp, Homo sapiens
  Payload ID: 12912
  Gene Symbol: PKD1
  Gene Name: polycystic kidney disease 1 (autosomal dominant)
  Uniprot ID: P98161
  ENST ID: ENST00000423118
  CDS Start-End: 210-13118
gcactgcagcgccagcgtccgagcgggcggccgagctcccggagcggcctggccccgagccccgagcgggcgtcgctcagcagcaggtcgcggccgcagccccatccagccccgcgcccgccatgccgtccgcgggccccgcctgagctgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctagacgtctcccacaacctgctccgggcgctggacgttgggctcctggcgaacctctcggcgctggcagagctggatataagcaacaacaagatttctacgttagaagaaggaatatttgctaatttatttaatttaagtgaaataaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccggccccccgccacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggagcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtcaccctccacggccaggatgtcctcatgctccctggtgacctcgttggcttgcagcacgacgctggccctggcgccctcctgcactgctcgccggctcccggccaccctggtccccgggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggctgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtggacctttggggatggggagcaggccctccaccagttccagcctccgtacaacgagtccttcccggttccagacccctcggtggcccaggtgctggtggagcacaatgtcatgcacacctacgctgccccaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtgcgggggctcgtcgtcaatgcaagccgcacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtgctcgaggccggcacctaccatgtgcagctgcgggccaccaacatgctgggcagcgcctgggccgactgcaccatggacttcgtggagcctgtggggtggctgatggtggccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcaggtgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggcctttgttggacagatgaagagtgacttgtttctggatgattctaagagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcagatgaagacctgatccagcaggtccttgccgagggggtcagcagcccagcccctacccaagacacccacatggaaacggacctgctcagcagcctgtccagcactcctggggagaagacagagacgctggcgctgcagaggctgggggagctggggccacccagcccaggcctgaactgggaacagccccaggcagcgaggctgtccaggacaggactggtggagggtctgcggaagcgcctgctgccggcctggtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcggagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtctgaggagctctggccatggatggcccacgtgctgctgccctacgtccacgggaaccagtccagcccagagctggggcccccacggctgcggcaggtgcggctgcaggaagcactctacccagaccctcccggccccagggtccacacgtgctcggccgcaggaggcttcagcaccagcgattacgacgttggctgggagagtcctcacaatggctcggggacgtgggcctattcagcgccggatctgctgggggcatggtcctggggctcctgtgccgtgtatgacagcgggggctacgtgcaggagctgggcctgagcctggaggagagccgcgaccggctgcgcttcctgcagctgcacaactggctggacaacaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaaggctgcccagcagctacgcttcgtgcgccagtggtccgtctttggcaagacattatgccgagctctgccagagctcctgggggtcaccttgggcctggtggtgctcggggtagcctacgcccagctggccatcctgctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggagttccgccacaaagtccgctttgaagggatggagccgctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggccagcactgcccagccgccttgcccgggccagtcggggtgtggacctggccactggccccagcaggacaccccttcgggccaagaacaaggtccaccccagcagcacttagtcctccttcctggcgggggtgggccgtggagtcggagtggacaccgctcagtattactttctgccgctgtcaaggccgagggccaggcagaatggctgcacgtaggttccccagagagcaggcaggggcatctgtctgtctgtgggcttcagcactttaaagaggctgtgtggccaaccaggacccagggtcccctccccagctcccttgggaaggacacagcagtattggacggtttctagcctctgagatgctaatttatttccccgagtcctcaggtacagcgggctgtgcccggccccaccccctgggcagatgtcccccactgctaaggctgctggcttcagggagggttagcctgcaccgccgccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacacctgctgcgcttggtaggtgtggtggcgttatggcagcccggctgctgcttggatgcgagcttggccttgggccggtgctgggggcacagctgtctgccaggcactctcatcaccccagaggccttgtcatcctcccttgccccaggccaggtagcaagagagcagcgcccaggcctgctggcatcaggtctgggcaagtagcaggactaggcatgtcagaggaccccagggtggttagaggaaaagactcctcctgggggctggctcccagggtggaggaaggtgactgtgtgtgtgtgtgtgtgcgcgcgcgcacgcgcgagtgtgctgtatggcccaggcagcctcaaggccctcggagctggctgtgcctgcttctgtgtaccacttctgtgggcatggccgcttctagagcctcgacacccccccaacccccgcaccaagcagacaaagtcaataaaagagctgtctgactgc

SEQ ID NO: 167263 - DNA, 608 bp, Homo sapiens
  Payload ID: 12912
  Gene Symbol: PKD1
  Gene Name: polycystic kidney disease 1 (autosomal dominant)
  ENST ID: ENST00000562425
  CDS Start-End: 1-275
gcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcgggtctgaggagctctggccatggatggcccacgtgctgctgccctacgtccacgggaaccagtccagcccagagctggggcccccacggctgcggcaggtgcggctgcaggaagcactctacccagaccctcccggccccagggtccacacgtgctcggccgcaggaggcttcagcaccagcgattacgacgttggctgggagagtcctcacaatggctcggggacgtgggcctattcagcgccggatctgctgggggcatggtcctggggctcctgtgccgtgtatgacagcgggggctacgtgcaggagctgggcctgagcctggaggagagccgcga

SEQ ID NO: 167264 - DNA, 465 bp, Homo sapiens
  Payload ID: 12912
  Gene Symbol: PKD1
  Gene Name: polycystic kidney disease 1 (autosomal dominant)
  ENST ID: ENST00000483024
  CDS Start-End: 1-465
cggcgggcgtgctggtggactcggccgtggaggtggccttcctgtggacctttggggatggggagcaggccctccaccagttccagcctccgtacaacgagtccttcccggttccagacccctcggtggcccaggtgctggtggagcacaatgtcatgcacacctacgctgccccaggtgagtacctcctgaccgtgctggcatctaatgccttcgagaacctgacgcagcaggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgc

SEQ ID NO: 167265 - DNA, 737 bp, Homo sapiens
  Payload ID: 12912
  Gene Symbol: PKD1
  Gene Name: polycystic kidney disease 1 (autosomal dominant)
  ENST ID: ENST00000488185
  CDS Start-End: 1-737
gggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgat

SEQ ID NO: 167266 - DNA, 6464 bp, Homo sapiens
  Payload ID: 12912
  Gene Symbol: PKD1
  Gene Name: polycystic kidney disease 1 (autosomal dominant)
  ENST ID: ENST00000487932
  CDS Start-End: 1-3369
cccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcaggtgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaagctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgagcaggcctttgttggacagatgaagagtgacttgtttctggatgattctaagagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcagatgaagacctgatccagcaggtccttgccgagggggtcagcagcccagcccctacccaagacacccacatggaaacggacctgctcagcagcctgtccagcactcctggggagaagacagagacgctggcgctgcagaggctgggggagctggggccacccagcccaggcctgaactgggaacagccccaggcagcgaggctgtccaggacaggactggtggagggtctgcggaagcgcctgctgccggcctggtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcggagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtctgaggagctctggccatggatggcccacgtgctgctgccctacgtccacgggaaccagtccagcccagagctggggcccccacggctgcggcaggtgcggctgcaggaagcactctacccagaccctcccggccccagggtccacacgtgctcggccgcaggaggcttcagcaccagcgattacgacgttggctgggagagtcctcacaatggctcggggacgtgggcctattcagcgccggatctgctgggggcatggtcctggggctcctgtgccgtgtatgacagcgggggctacgtgcaggagctgggcctgagcctggaggagagccgcgaccggctgcgcttcctgcagctgcacaactggctggacaacaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgc

SEQ ID NO: 167267 - DNA, 2545 bp, Homo sapiens
  Payload ID: 12912
  Gene Symbol: PKD1
  Gene Name: polycystic kidney disease 1 (autosomal dominant)
  ENST ID: ENST00000568591
  CDS Start-End: 1-603
ctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtcaccctccacggccaggatgtcctcatgctccctggtgacctcgttggcttgcagcacgacgctggccctggcgccctcctgcactgctcgccggctcccggccaccctggtccccgggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggctgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtggacctttggggatggggagcaggccctccaccagttccagcctccgtacaacgagtccttcccggttccagacccctcggtggcccaggtgctggtggagcacaatgtcatgcacacctacgctgccccaggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcct

SEQ ID NO: 167268 - DNA, 1822 bp, Homo sapiens
  Payload ID: 12912
  Gene Symbol: PKD1
  Gene Name: polycystic kidney disease 1 (autosomal dominant)
  ENST ID: ENST00000567946
  CDS Start-End: 1-1822
cggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgagcaggcctttgttggacagatgaagagtgacttgtttctggatgattctaagag

SEQ ID NO: 167269 - DNA, 665 bp, Homo sapiens
  Payload ID: 12912
  Gene Symbol: PKD1
  Gene Name: polycystic kidney disease 1 (autosomal dominant)
  ENST ID: ENST00000561668
  CDS Start-End: 1-137
ccggccccagggtccacacgtgctcggccgcaggaggcttcagcaccagcgattacgacgttggctgggagagtcctcacaatggctcggggacgtgggcctattcagcgccggatctgctggggagctgggcctgagcctggaggagagccgcgaccggctgcgcttcctgcagctgcacaactggctggacaacaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaagg

SEQ ID NO: 167270 - DNA, 9092 bp, Homo sapiens
  Payload ID: 12913
  Gene Symbol: PKD1L1
  Gene Name: polycystic kidney disease 1 like 1
  Uniprot ID: Q8TDX9
  ENST ID: ENST00000289672
  CDS Start-End: 52-8601
ggaagaagctggtctgctgactgtcatacttgtgaccagcttgcacaggacatggccgaggaggcagcccagaacatttctgatgaccaggaaaggtgtctccaggctgcctgctgcctttcctttggtggtgagctgtctgtgagcactgacaagagctggggtcttcatctgtgcagctgtagccctcctggaggtggattgtgggtcgaggtctatgctaatcatgtgcttcttatgagtgatgggaagtgtggctgtccttggtgtgctctgaatggaaaggcagaagaccgggaatcacagagcccatcctcatcagcttccaggcagaagaacatttggaaaacaactagtgaagcagcgttaagtgttgttaatgaaaaaacacaggctgttgttaatgaaaaaacacaggcgcctctggattgtgataacagtgctgatagaattccccacaaacctttcattataatcgcaagggcctggagcagtggtggccccaggttccatcacaggcggctgtgtgctactgggaccgcagacagcacattctctgctcttctccagctccagggcaccacttctgcagcagctccctgcagcctgaagatggaggcttcctgctgtgtcctgagactgctgtgctgtgcggaggatgtggccacggggctgcttcctgggactgtcacgatggagacccccaccaaggtggccagacccactcagaccagctcccagcgagtgcccctgtggccgatttcacattttcccacttctcccagaagctcccacggccttccgcctggcattcctcgcacccccagcttcacggcatcgcagtctggttctgagatcctctatccccctactcagcatcctcctgtggccatcctagctcgaaattctgataacttcatgaaccctgttcttaattgctccctggaagtggaagctcgggcacctccaaatctgggattccgtgttcatatggcttctggagaggctctctgtctgatgatggatttcggggacagttctggggttgaaatgaggctacacaacatgtctgaggcaatggcggtgactgcctaccaccagtactcaaaaggtattttttttcatcttttacattttcagttggatatgtccacctacaaagaagcagagacacaaaatacaactttaaatgtttacttgtgccaaagtgaaaacagctgcctggaagactcagaccccagtaaccttggatatgagcttatttctgcctttgtcaccaaaggagtctatatgctcaaggctgttatttataacgagtttcatggaaccgaagtggagcttgggccttattatgtggagattggccatgaggccgtgtctgcgttcatgaactccagcagtgtccatgaagatgaagtgcttgtctttgctgactcccaagtgaatcagaaaagcactgtggttatacatcactttccatctattccttcatataacgtgtcctttatttctcagactcaagtgggtgacagccaggcttggcacagcatgactgtctggtataagatgcaatccgtctctgtctacacaaatggaactgtgtttgccacagacacagacattacatttacagctgttaccaaggaaacaatacccctggaatttgagtggtattttggagaggatccaccagtgaggacaacttcaagaagcattaaaaaaagactcagcatcccccaatggtatcgtgtgatggttaaggcttccaacaggatgagcagtgtggtctctgagccccatgtcatcagggtgcagaagaaaattgtggccaatcggctcacgtccccctcctcagctctggtaaatgccagtgtggcctttgagtgctggatcaacttcggcacagatgttgcctacctgtgggactttggggatggcaccgtcagcctggggagcagctccagcagccatgtctacagtagggaaggagaatttacagtggaggtccttgccttcaataatgtcagtgcctccactctaagacagcaacttttcatcgtgtgcgagccctgccagccacccctggtgaagaacatggggcctgggaaagtccagatatggaggtctcagcctgtgaggctgggagtgacgtttgaagctgcagtcttctgtgatatttcccaaggtctttcttacacctggaacttgatggactctgaagggctccctgtctccctccctgctgctgtggacactcacagacagaccctcatcctcccgagccacaccttggagtatgggaactacactgcccttgccaaggttcagattgaaggcagtgtggtgtacagcaactactgtgtgggcctggaggtgcgagcccaggcccctgtcagtgtgatctccgagggcacacacctattcttctccaggaccacctcatcccccattgtcctcagagggacccagtccttcgaccctgacgaccctggggcgactctcaggtatcactgggaatgcgccaccgctggctccccagcacatccctgcttcgactcctccactgcacaccaactggatgccgcggctcccactgtttcctttgaggcacaatggctcagtgacagctatgatcagttccttgtgatgctgagggtctccagtggtggccggaactcttctgagacccgggtgttcctgtccccctaccctgactcggcgttcagattcgtccacatctcctgggtcagctttaaagacaccttcgtcaactggaatgacgaactctctcttcaagctatgtgtgaggactgcagtgaaataccgaatctgtcttattcctgggatctctttttagtcaatgcaacagaaaagaataggatagaagttcccttctgcagagtagtggggctgcttggctcgctgggactcggtgccatttcagagtcatcacagttaaacctgctgcccactgagcctggcactgcagatcctgatgcaacgaccacaccattctcacgggaaccttcacccgtgacccttggccaacctgccacttcagctccaaggggaacccccacagagcccatgactggagtctactggattcctcctgcgggggactctgcagtcctgggggaggctccagaggaaggttcactagacctagagccagggccacagagcaagggatccctgatgactggccgctctgagagaagtcagcccacccacagccctgaccctcacctctctgattttgaagcctattacagtgacattcaagaagcaataccatcgggaggaagacagccagctaaggacaccagctttccaggatcaggacctagcttgagtgccgaggagagccctggagatggggataacctggtggacccctccctgtctgcaggcagagccgagcctgtcctcatgattgactggcccaaggccctgctgggtcgagcagttttccaaggctattcatcctcaggtattacagaacagacagtgacaatcaagccatactctctgagcagtggagagacgtacgtcctgcaagtgtctgtggcttcgaagcatggcttactgggtaaagctcagctgtacttgacagtcaacccggctcctcgggacatggcctgtcaggtgcagccccaccatggtctggaagcacacaccgtcttcagtgtcttctgcatgtctggaaaaccggacttccattatgaatttagttaccagataggaaacacctccaaacacactttgtaccatgggagagacacccagtattattttgtgttgccagctggtgagcacttggacaattacaaagtcatggtttccactgaaatcacagatggcaaaggctccaaggtccagccgtgcactgtggtggtgactgtgctgccccgctaccatggaaatgactgtctgggcgaggacctgtataattccagcctgaaaaacctttctaccctccagctgatggggagttacacagaaatcaggaactacatcactgtgatcaccagaatcctgagtcgtttgtctaaggaggacaaaactgcctcctgcaaccaatggtcacgaatacaggatgcattaatttcttcagtatgcagattggcttttgtagatcaggaagaaatgattggttctgttcttatgttgagggacctcgtgagcttctctaataagctaggctttatgagtgcggttctcatcctcaagtacacccgggcactccttgctcaaggccagttctcggggccatttgtgattgacaaaggagtgaggcttgagctcatcggtctcatatccagagtctgggaagtctctgagcaagaaaactcgaaggaggaagtctatcgacatgaagaaggaattacagtcatctcagatttattgttgggttgtctctctttgaaccatgttagcactgggcagatggagttccggacccttcttcattacaaccttcagagctctgtccagagcctgggatctgtccaggtgcatttacctggtgaccttgctgggcacagtcctgctggggcggagacacagagcccatgctacattagccagctcatactcttcaagaagaacccatatccagggagccaagctcctgggcagattggtggagttgtgggcctcaacctctatacctgctccagcagaagacccatcaacaggcaatggctaaggaaacccgtgatggtcgagtttggggaggaggatggcctggataataggagaaataaaacgacatttgtattacttcgggataaagtgaatctccatcagttcactgagctttccgaaaacccccaggaatctctacagatagaaattgaattttccaaacctgttacaagggcatttcccgtcatgttgctagtaagattctctgagaaacctactccctctgattttcttgtgaagcagatctacttctgggatgagtcaattgtgcagatttatatacctgctgcttctcagaaagatgccagtgtaggctatttatccttattggatgctgactatgacagaaaacctccaaacagatatttagctaaggcagtgaactatacagtacatttccagtggatccgatgcctgttttgggacaagagagagtggaaatctgaacgtttctctccacaaccagggacttctcctgaaaaagtgaactgcagctaccatcgcctcgcggcattcgctctcctaaggagaaagctgaaggccagttttgaagtgagtgacatttccaagctacagagccacccagaaaacttgcttcccagtatttttattatgggttctgtgattctttatggatttttggtcgctaaaagtagacaagtagatcatcatgaaaaaaagaaagctggttacatctttctgcaagaagcttccctgccgggccatcagctatatgcggtcgtcattgacactggcttccgagctccggccaggttgacctcaaaggtgtacattgttttatgtggcgacaatggactgtcagaaaccaaggagctctcctgtccagagaagcccctgtttgaaaggaattccagacacacctttatcctgagcgctcctgcccaactgggcctgctgaggaagatccgcctctggcacgacagccgtgggccttccccaggctggttcatcagccacgtgatggtgaaggagctgcacacgggacagggctggttcttccctgcccagtgctggctgtctgccggcaggcatgatggtcgcgtggagcgggagctcacctgtctgcaagggggactcggcttccggaagcttttctattgcaagttcacagagtacctggaggatttccatgtctggctgtcggtgtacagcaggccctcctccagccgctacctgcacacgccgcgcctcaccgtgtccttctccctgctgtgcgtctacgcgtgtctcactgccctggttgctgctggagggcaagagcagccccacttggacgtcagccccacccttggatccttcagggtgggtctcctgtgtaccctcctggcttctccaggggcccagctcttgtccctgctcttcaggctcagcaaggaagccccggggtctgcccgagtggagccacacagcccacttagaggaggagcacagaccgaggcaccccatggtcctaattcctggggaaggataccagacgcacaggagccacgcaagcaacctgcatcagccattctctctgggagtggcagggcccaaaggaaggcggcaagtgacaatggcacagcttgtccagcccctaagctgcaggttcatggggctgaccacagcaggacttctctgatggggaaaagccactgctgccctccccacactcaagcacccagcagtggtttggagggactaatgccccagtggtcaagggcccttcagccttggtggagctctgcagtgtgggccatttgtgggaccgcttctttggcctgcagtttggggacaggatttctagcctacaggtttggccaggagcaatgtgtgcagtggctgcacctgctgtccctctccgtggtctgctgtattttcatcacccagccacttatggtatgcctcatggccttgggttttgcttggaaaagaagagctgacaaccacttttttactgagtctttatgtgaggctaccagggatctggactctgaattggcagaacgttcctggactcgcctccccttctcttcaagctgcagtattcctgactgtgcaggcgaggttgaaaaagtcttggctgcccgacaacaagctcgccacctgcgctgggcgcatccaccatccaaggcccagctgaggggcaccagacagaggatgaggagagagagtcgcacacgggctgccctgagagacatttccatggacatcctcatgctgcttctgcttttgtgtgtaatatatgggagattttcccaagatgaatactccctcaatcaagctatccggaaagaatttacaagaaatgccagaaactgcttgggtggcctgagaaacatcgctgactggtgggactggagtctgaccacacttctggatggcctgtacccgggaggcaccccgtcagcccgtgtgccgggggctcagcctggagctcttggaggaaaatgctacctaataggcagttccgtaattaggcagctaaaagtttttcctaggcatttatgcaagcctcccaggccattttcagcactcatcgaagactctattcctacatgtagtcccgaagttggaggccctgagaacccctacctgatagacccagagaaccaaaacgtgaccctgaatggtcctgggggctgtgggacaagggaggactgtgtgctcagcctgggcagaacaaggactgaagcccacacagccctgtcccgactcagggccagcatgtggattgaccgcagcaccagggctgtgtctgtgcacttcactctctataaccctccaacccaactcttcaccagcgtgtccctgagagtggagatcctccctacggggagtctcgtcccctcatccctggtggagtcattcagcatcttccgcagcgactcagccctgcagtaccacctcatgcttccccagctggtcttcctggcactcagcctgatccacctctgtgttcaactctaccgtatgatggacaagggcgtcctcagctactggcgaaagccaaggaactggctggagctctccgtggttggagtgagcctcacctactatgcagtttccggccaccttgttactcttgctggagatgtcactaaccagtttcacagaggactttgccgagcatttatggacctcacccttatggcatcatggaatcagagggctcgatggctccggggaatcctcttattcctcttcacattaaaatgcgtctatcttcctggcattcaaaacacaatggcatcctgctcctccatgatgcgccactcactccccagcatctttgtagcagggctggtgggggcactgatgctggccgccctctcccacctgcaccgatttctgctctctatgtgggttctaccacctggcaccttcacagacgccttccccgggctgctgtttcattttcccagaagaagccaaaaagactgcctccttggcctttccaagtctgaccagcgggccatggcttgttactttgggatccttttaatagtctctgccacactgtgttttggaatgctgagaggttttctcatgactttaccccaaaaaagaaaatcttttcaaagtaaatcttttgtgagacttaaagatgtcactgcttatatgtgggaaaaggtcctcacctttctgagactggaaacaccaaagttggaagaggctgagatggttgagaatcacaattactacttggatgaatttgcaaatctgttagacgaacttctgatgaagattaatggtttgtccgacagcctacaactcccccttctggaaaaaacatccaacaacacaggggaggcaaggacagaagagagtcccttagtggacatttctagttaccaagctgctgagccagcagacatcaaggacttctgaggagcctggtaccttgcataggcactatggaccctgttttgcttaacccacccaacagccaattttagcagacatcctagttttgcaggtgagaagagctgaggtacgaagaagttttgttaatttttccagttcacgtaacaagtaaatgggaaaccaggatgaaaatcaaggtttatctgtcatcagactgttactcataatcaccattcggagagttcagatgtgggacaagattctaactccagccttctcccaaatggttaatttgccagttgccctagagttacatattgtcttatttgtttgttttactgaatctgtctgagtattaaaagccttgtatcttgtgaaatttctttcaggtctcataaaagcgatgaaagagaccaggataacattctaatatttaaataagatttttgaagtaaaatccttattttgtaaatttaacaattgaatcttgctagattaataacgcatctttcctg

SEQ ID NO: 167271 - DNA, 520 bp, Homo sapiens
  Payload ID: 12913
  Gene Symbol: PKD1L1
  Gene Name: polycystic kidney disease 1 like 1
  ENST ID: ENST00000433506
  CDS Start-End: 1-493
agttggaggccctgagaacccctacctgatagacccagagaaccaaaacgtgaccctgaatggtcctgggggctgtgggacaagggaggactgtgtgctcagcctgggcagaacaaggactgaagcccacacagccctgtcccgactcagggccagcatgtggattgaccgcagcaccagggctgtgtctgtgcacttcactctctataaccctccaacccaactcttcaccagcgtgtccctgagagtggagatcctccctacggggagtctcgtcccctcatccctggtggagtcattcagcatcttccgcagcgactcagccctgcagtaccacctcatgcttccccagctggtcttcctggcactcagcctgatccacctctgtgttcaactctaccgtatgatggacaagggcgtcctcagctactggcgaaagccaaggaactggctggaggtagcctctcttgtgtcattttcttttgaaaaataacaataaactgtttatatcttgaaaaaa

SEQ ID NO: 167272 - DNA, 3427 bp, Homo sapiens
  Payload ID: 12914
  Gene Symbol: PKD1L2
  Gene Name: polycystic kidney disease 1-like 2 (gene/pseudogene)
  Uniprot ID: Q7Z442
  ENST ID: ENST00000337114
  CDS Start-End: 1-2976
atgagtgcagtgggcttggtactcctggtgcttgctctgaggcttagggccaccactgttaagccagaggaaggcagcttttgctctaacagccaggtggccttcagagatgcttgctatgaatttgtgccactcggacgcaccttccgtgatgcccagagctggtgcgaggggcaaggaggccatttggtcttcattcaggacgaaggcacccagtggtttctgcagaagcacatctcccaggacagggaatggtggattggactcacgtggaacttggcacggaatggaaccacggaggggccggggacttggttggacacctccaatgtgacctacagcaactggcatggagggcaggccgccgctgcccctgacacctgcggccacatcgggagaggcccttcctctgagtgggtgacctcggactgcgcccagaccttcgccttcatgtgcgagttccgggttggccagagcctggcctgcgagggactcaatgccaccgtgcactgtggcttggggcaggtcatccaggtccaggatgccgtctacgggcgccagaatccccatttctgcacccaggatgccgggcgtccttcagatctggagcagggatgcagctgggccaacgtcaaggaggaggtggcaggccagtgccaggagctacagtcatgccaggtggcagcagatgagacctactttggaaacctgtgtccgactcagggcagttacctgtgggtgcagtaccagtgccgggaagccctgcagctgatggtgtccagtgagagtttcatctttgacaatgtcaccatctccctgacgtggctcctctcaccctacataggaaacctgtcctgtataattagtacaggagacagccacacttttgatccctacaacccgccgagtgtgtccagcaatgtgacccaccagttcacatctcctggggaattcaccgtgtttgctgaatgcacaaccagtgagtggcatgtgacagctcagaggcaggtgaccgtgcgagacaagatggagacgctcagtgtgactgcatgctccggcctgtcccagtcaggagccggccctctctgccaggctgtctttggggatcctctgtggattcaggtggagcttgatggaggaacaggagtgacttacactgtgcttttgggtgacataaccctggccgagtccaccacccaaaagggctcgctaccgtacaatctgatcctggacagagaaacccagaaactgatgggccctgggaggcaccgcctggagatccaagccaccggcaacaccaccacctctacaatctccagaaacattacagtccacttggtggagctgctgtcagggctgcaggcctcctgggcttctgaccatttggagcttggacaggacctattgatcaccatctcattggctcagggcaccccggaagagctgacctttgaggtggctggactcaatgcaaccttctcccacgagcaagtgagctttggagagccatttgggatttgccgcctggctgttccggttgaaggcacctttctggtcaccatgctggtgaggaatgccttctccaacctgagtttggaaatcgggaacatcactatcacagccccttccggtctccaagaaccatctgggatgaatgctgaaggaaagagtaaagataaaggcgatatggaggtgtacatccaacctggtccatatgtggatcctttcacgacagtgaccctgggctggccagacaatgacaaggagttacgcttccaatggtcatgtgggtcttgctgggctctgtggagcagctgtgttgagaggcagctgcttcgcacagaccagagggagctggtggttccagcatcctgcctgccgccgcctgactctgctgtcaccctgcgcctggctgttctgagaggccaagagctggagaacagggcagagcagtgcctctacgtgtctgcgccctgggaactcaggcctcgagtcagctgtgagaggaactgcaggccagttaatgccagcaaagacattctgctcagggtcaccatgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccaggggtcctgcatgggcgattcatgggaaggtgcccctcctgctgcccatgtatctcacgctaggtgagagggcctgtttgcccagactctcactcctgcatctgctggtgagcaagttgagggagtaactgaatctcattaatatttgggtggccaaatgtgagtccagacactgctactgactgcccatgttctcaacttcagtacatgccagcctgacatctggctgccagctcctgtgcttccttatccttctgggggtcttctctgaccctcagagcctactgtacctgcccatatggctgtgaattcatgcagtgttcagtgactaatgaagctggcttataaacaccccagctacctcacccctcttgatggataatcccaagcaggagtgaatcccaggtaatgggcttgatcacactcctgtactggcttccacccttccctgtctcacaccccctactccccacaagtgtttcttgggatcatgtccaaataaatgacttgctctcaaa

SEQ ID NO: 167273 - DNA, 4165 bp, Homo sapiens
  Payload ID: 12914
  Gene Symbol: PKD1L2
  Gene Name: polycystic kidney disease 1-like 2 (gene/pseudogene)
  Uniprot ID: Q7Z442
  ENST ID: ENST00000527937
  CDS Start-End: 115-837
agatgatagcaatgcctcggggagcttcctcactctgtcctctgtctgcctttcagctgtgagaggaactgcaggccagttaatgccagcaaagacattctgctcagggtcaccatgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtacccgtgggaagctggggggctcctttcattcccttcctctggggccccagggtctgcgtgcggccatttgggctgtggatcaaggttcatggatcaggggagaaacctgtggtgtctcccaagcggctgacaccacctccctctctggtcttttgggtgagtgacataaagtgaagaaaatgccttcttccttggtaacctgctttctcggctggccctcatggaggcacaggcctctgggatggggggagtttagaacacatcatcccctgcttttcatgtttcagatgacaaggcagagccccagagcagaaaggggactgtcctcggtcacatgggtagcggtttggagttggaccacagatggcgtcccggctttgtcacttaccattcgcattgtcacaggccagggaccaaacctctctaagtctcagtttccccatatagaagaatactagtctcctcatacaattgtagtaagagttaaataagaattacgatcactgcaactaaaaaactagataagaccgtcaacattcaatcagttttaatctacaaaaatggccgttccattgttacaacctagtatgataaactattgcagaacgtatgattgtgtccactcccagcatgtgccacatgagtttgtgttcgtgtgtgtgcatgcacacacccacacacacacccctgtgggcacggagaagagaagaaagacttctcttggctccctgaaaggtttgcaggaaggtactgagtgtggtgctagaggcctggtaggtacttaatacaggaagccggattgtcattgtggtcgcttaccgagagaaactaacatgtatcaagcacctgctatgagctgccaggccctgaattagggcttcatggatctgtaatccccactacaaccctgggacgtaaatggtgaggcctccatctatgttacagctgaggaaacagagggtaagagaatcagaggtgcctgcctgtgtccctgtgtctggtaagtggtgaagcctgggttcaaacccagtttagaggttccccctccacctccagccctcttaccccagaccccctgccacatacatacacattagctctcacacatcatacatacacactttcacacacactcttatgcacacacacacactcaaacatgttcacacacacacactcacaaacacattcacatactcccacacacatactcacacacttatacgcatatacatacatgctcacacactcactcatatgactcatactcacacacatacacacactgacagatgctcacacacacacactcatatacacacatacacatgcacacacaaactcacacacatgctcacacacatacactgacacgctgtcacacacacacatactcccacacacaattatgctttcacacatacacatacatacacactcacacactttcacacacacacagctctcattcttggtcacattcactctgagaagtaccaatgggaagcttcccctggacatcctgtggtccccaagcacacagaccacacagcctaacccaaggtctccccatgaaatgcccggggcctggcacaagacagatgtcaaactctcactgggaagctgagaagatgttaacaagggctctgttgagacaggtgtgtgcagggcttagggaacaaactagacagcgtggaggaccccagaggcccggcctgccgtgagcaggatccagggggcggctgcccacagagggactctctggtaggagctgtggcttttgaagaatgaggcggccagcccccggtgacctggccgagggcatcaggagaatgacccctcccagctctctctcctcctgccatctcgtcccctgctgggctcctgctgggtgagtccatttgccggagggtccagagccggtgacatctttacccagggtaggtgacaaacgatggggtcagggcctgcagaagcaaatgtgagattacccattatctgagtttcccttctggaatattctgcaaagagtctcctgccacactgacctattctttcctcaacccaagacacagccgggatggaggcctggctgtccctggaatggatggcagatgcactcatacttggaagcttcgggaaagcctgtcaggctgagccaggtgtgagcaacaggccacggtgtctctgccccatcaaaagtggctgctgcttaaatctaagtcattattaaaattaaataaagttacaaatgacagttctactgggcagtgctgaaatgatgttcttagtttttctctgctcctaccaaagcccctcaccagcccctcattagtgctttgtagtgtagaaagcacttgaccctgaagcccgtggcctggcccaagacaggagtggagggctgggtaggggggttcttgtccccactgctgcaaaggcacacagggaccccaagcctccggtgagacctcccatccatgccagaccaacagtcatccagtttctgaatttcatgccattctggtcacaggtgccacgctgagacacaatttattttcaaatagtgccaaattctacagattcaatttgaagatttggagaaagcttgagacatcctatatatgtttgctagggctgctgttacaaatgaccacaaagatcatggcttaacgcaacacgcatttattcactttatagttctggaggccagaagtttaaaatggggtccactaggccaaaagtaaggtgatggcagagctgcaaacctggaggctccaggagagaagccattccttgccttttccgggttctagaggccgcctgcactccttgactcctatcttcaaagccagccacgcagcatctccaaagtcctctcctctccctctgtctctccccacccttacctcatcctctttccctctctttttcttccccctacccctgcctccatcacccatctcctgttctgattaacgttcctacctccctcttagaagggtcgtatgatgacgttggtcccacctgttcggataatctctccatctcagaatttttaacttaattgcttctccaaaatgacttagtcaaagtgccttttgccacattcagtaacatattcacaggtttcagggatgtgaatgtgggcatcttgagggggctgttatctgcctaatcacacatcatacaaggcagacagaggtctgcagggctttagaaaccaccagtgaggccaggtgcggtggctcacgcctgtaatacctgcactttggaaggctgaggcaggtggatcacttgaggtcagaagttcaagaccagcctggccaacatggcaaaaccctgtctctactaaaaatacaaaaaattagctggtgatggtggtgcgcacctgtaatcccagctactcaggaggctgaggcccgaacccaggaggcggaggttgcaatgagtcgagatcatgccagtgtactccagcctgggtgacagagcgagactctgactc

SEQ ID NO: 167274 - DNA, 7379 bp, Homo sapiens
  Payload ID: 12914
  Gene Symbol: PKD1L2
  Gene Name: polycystic kidney disease 1-like 2 (gene/pseudogene)
  ENST ID: ENST00000525539
  CDS Start-End: 1-7379
atgagtgcagtgggcttggtactcctggtgcttgctctgaggcttagggccaccactgttaagccagaggaaggcagcttttgctctaacagccaggtggccttcagagatgcttgctatgaatttgtgccactcggacgcaccttccgtgatgcccagagctggtgcgaggggcaaggaggccatttggtcttcattcaggacgaaggcacccagtggtttctgcagaagcacatctcccaggacagggaatggtggattggactcacgtggaacttggcacggaatggaaccacggaggggccggggacttggttggacacctccaatgtgacctacagcaactggcatggagggcaggccgccgctgcccctgacacctgcggccacatcgggagaggcccttcctctgagtgggtgacctcggactgcgcccagaccttcgccttcatgtgcgagttccgggttggccagagcctggcctgcgagggactcaatgccaccgtgcactgtggcttggggcaggtcatccaggtccaggatgccgtctacgggcgccagaatccccatttctgcacccaggatgccgggcgtccttcagatctggagcagggatgcagctgggccaacgtcaaggaggaggtggcaggccagtgccaggagctacagtcatgccaggtggcagcagatgagacctactttggaaacctgtgtccgactcagggcagttacctgtgggtgcagtaccagtgccgggaagccctgcagctgatggtgtccagtgagagtttcatctttgacaatgtcaccatctccctgacgtggctcctctcaccctacataggaaacctgtcctgtataattagtacaggagacagccacacttttgatccctacaacccgccgagtgtgtccagcaatgtgacccaccagttcacatctcctggggaattcaccgtgtttgctgaatgcacaaccagtgagtggcatgtgacagctcagaggcaggtgaccgtgcgagacaagatggagacgctcagtgtgactgcatgctccggcctgtcccagtcaggagccggccctctctgccaggctgtctttggggatcctctgtggattcaggtggagcttgatggaggaacaggagtgacttacactgtgcttttgggtgacataaccctggccgagtccaccacccaaaagggctcgctaccgtacaatctgatcctggacagagaaacccagaaactgatgggccctgggaggcaccgcctggagatccaagccaccggcaacaccaccacctctacaatctccagaaacattacagtccacttggtggagctgctgtcagggctgcaggcctcctgggcttctgaccatttggagcttggacaggacctattgatcaccatctcattggctcagggcaccccggaagagctgacctttgaggtggctggactcaatgcaaccttctcccacgagcaagtgagctttggagagccatttgggatttgccgcctggctgttccggttgaaggcacctttctggtcaccatgctggtgaggaatgccttctccaacctgagtttggaaatcgggaacatcactatcacagccccttccggtctccaagaaccatctgggatgaatgctgaaggaaagagtaaagataaaggcgatatggaggtgtacatccaacctggtccatatgtggatcctttcacgacagtgaccctgggctggccagacaatgacaaggagttacgcttccaatggtcatgtgggtcttgctgggctctgtggagcagctgtgttgagaggcagctgcttcgcacagaccagagggagctggtggttccagcatcctgcctgccgccgcctgactctgctgtcaccctgcgcctggctgttctgagaggccaagagctggagaacagggcagagcagtgcctctacgtgtctgcgccctgggaactcaggcctcgagtcagctgtgagaggaactgcaggccagttaatgccagcaaagacattctgctcagggtcaccatgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccagtgggaggccagcttggctctacagcatgccagtgaggccctgttgacagtgagtgccaaggcccgccctgaggaccagaggcgccaggcagccaccagggacctgtttcaggctgtgggcagtgtgctggaagcttccctgagcaacagaccagaagagcctgcggaggccagcagcagccagattgccacagtgctgcggctgcttcgagtcatggagcatgtgcagaccaccctcctgctgggaaaactgccagggggccttccagccatgctggccaccccctccatctctgtgtacacaaacagaatacaaccctggagttggcaaggctcctccctgcgccctgatgccgcagactctgcaaccttcatgctgcccgctgcctcctccctcagctctctggagggcggccaggagcccgtggatataaagatcatgagtttcccaaagagcccctttccagcccgaagccactttgatgtcagcgggactgtcggtggcctccgtgtgaccagccctagtggtcaactcatacctgtgaagaatctgtcggagaatatcgagatcctgctgccccggcattcacaaagacacagccagccgaccgtgttgaacctgaccagtcctgaagctttgtgggtgaacgtgacttcaggggaggcaaccttggggatccagctgcactggagaccagacattgcactcacgcttagcctgggctatggctaccaccccaacaagagcagctacgatgcccaaactcacctcgtaccaatggtggctccagatgagctgcccacgtggatcctgagcccacaggacctgcgttttggagaaggggtctactatttgactgtggtccctgagtctgacctggagccagcccccggcagggacctcacggttggcatcaccaccttcctgtctcactgtgtgttctgggatgaggtccaggagacttgggacgactcaggatgccaggtggggcctcggaccagcccctaccagacacactgcctctgcaaccacctcactttcttcggaagcacgttcctggtgatgtccaatgccatcaacatccaccagactgctgagctctttgccacctttgaggacaaccctgtggtcgtgaccaccgtgggctgcctgtgtgtggtctacgtgctggtggtgatctgggcgaggaggaaggacgctcaggatcaggccaaggtgaaggtcacagtgctggaagacaatgatccctttgctcagtaccactacctggtgacagtctacacaggacaccgacgaggggcagccacgtcctcaaaggtgactgtcaccctgtatggcctggatggagagagagagccccaccacctggctgatcccgacactccggtttttgagcgaggagcagtggatgccttcctcctctccaccctgttccccctgggagaactgcggagcctccggctgtggcatgacaactcaggggaccggccatcgtggtatgtgagccgggtgctggtctatgacctggtgatggaccggaagtggtatttcctgtgcaactcctggctatccatcaatgttggagattgcgtcctcgataaggtgtttcctgtggccacggagcaggacagaaaacaattcagccacctgtttttcatgaagacttccgcgggcttccaggatggacacatctggtattcgatcttcagccgctgcgctcgcagcagcttcacccgcgtccagagggtgtcctgctgcttctccctgctgctgtgcaccatgctgaccagcatcatgttctggggggtccccaaggacccagctgagcaaaagatggacttgggtaaaattgaattcacctggcaggaggtgatgattggcctggagagctccatcctcatgttccccatcaacctcctgattgttcagatctttcagaacacccgtccccgggtcgcgaaggagcagaacactggaaaatgggaccgggggtcccccaacctgactccctccccacagcccatggaggacggccttctgacacctgaggcagtgaccaaggatgtgtcaagaatcgtcagctccctcttcaaagctctcaaggtgccatcccccgccttgggctgggactcagtgaacttgatggacatcaacagtctcctcgccttggtggaagatgtcatttatccacagaacacatcagggcaggtgttctgggaggaagccaaaaagagagaggaccctgtaacactcactttggggtcatcagaaatgaaagagaaatcacagtgtcccaagcccaaggcggcacggagtggcccctggaaggacagcgcctacaggcagtgtctgtaccttcagctggaacacgtggagcaagagctgcggctggtggggccccgaggcttctcccagccccacagccatgcccaggccctcaggcagctgcagaccctgaagggcggcctgggggtacagccgggcacctgggcccctgcacatgccagcgctcttcaggtgagcaaaccccctcaaggcctgccctggtggtgcatcctggtgggctggctcctggtagcggccaccagtggcgtggcggccttcttcaccatgctctacggcctgcactacgggagggccagctccctcaggtggctcatctccatggctgtctccttcgtggagagcatgttcgtcacccagcccctgaaggtgctgggattcgctgctttctttgcactggtcttgaagagagtggacgatgaggaggatactgtggccccgctgccaggacatctgttgggcccagacccctatgccttgttccgagcacgaagaaacagcagcagggatgtctaccagccacctctcaccgctgccattgagaagatgaaaaccacccacctcaaggaacagaaagcatttgccctcatcagagaaatcctggcatacttgggcttcctgtggatgctactgctcgtggcctacgggcagagggaccccagcgcctaccacctcaacagacacctccagcacagcttcaccaggggcttttcaggtgtgctcggcttccgagagttcttcaagtgggccaacaccaccctcgtgagtaacctgtatggtcaccccccaggctttatcactgatgggaactccaagctggttggcagtgcccagattcgtcaagtgagggtccaggaaagctcttgccctcttgcccagcagccgcaggcatatctcaacggatgccgtgcaccatattccctggatgctgaagacatggcagactatggggaaggctggaatgccaccaccctcagtaatggcagtaccagagccaggaccaacgtcaagggtatcccatctggggcaaactcactgtgtaccggggaggaggctacgtggtccccttggggactgatcgccaaagcacgtcaagaattctccgctatctctttgacaacacctggctggacgccctgaccagagctgtgtttgtggagtccactgtctacaacgccaacgtcaacctgttctgcattgtcacgctgacgctagagaccagcgctctgggcaccttttttacgcacgcggccctgcagagcctccgcctgtaccccttcaccgacggctggcaccccttcgtggtagcggcagagctcatctacttcctcttcctcctctactacatggtggtgcagggcaagcgcatgagtaaagagacgtggggctatttctgcagcaagtggaaccttctggagctggccatcatcctggccagctggagcgccctggcggtgtttgtgaagagggctgtcctggccgaaagggacctccagcgctgccggaaccacagggaggaaggcatcagcttcagtgagacagcagcagccgatgccgcccttggctacatcattgccttcctggtactcctgtccacagtgaagctttggcatctgctcaggttgaatcccaaaatgaacatgatcacggcagccctacgccgtgcctggggcgacatttcaggctttatgattgtcatccttaccatgctcctggcttactccatcgcgtcaaacttgatatttggttggaaactccgttcctacaaaaccctctttgatgcggcggagacgatggtcagccttcagctgggaatcttcaactacgaggaggtcctggactatagcccagtgcttggctccttcctcattggatcctgcattgtttttatgacatttgtggtgctgaacctgtttatctctgtcatcctggtggccttcagtgaggagcaaaaatactatcagctgtcggaggaaggggagatcgtagatttgctgctgatgaaaatactcagtttcctgggcattaagtctaagagagaggagcctggaagcagcagggagcagcctgggtctctgtcccagactcgccactctcgaccagcacaagctttgcccaaggactaa

SEQ ID NO: 167275 - DNA, 5669 bp, Homo sapiens
  Payload ID: 12914
  Gene Symbol: PKD1L2
  Gene Name: polycystic kidney disease 1-like 2 (gene/pseudogene)
  ENST ID: ENST00000533478
  CDS Start-End: 112-5435
tgatagcaatgcctcggggagcttcctcactctgtcctctgtctgcctttcagctgtgagaggaactgcaggccagttaatgccagcaaagacattctgctcagggtcaccatgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccagtgggaggccagcttggctctacagcatgccagtgaggccctgttgacagtgagtgccaaggcccgccctgaggaccagaggcgccaggcagccaccagggacctgtttcaggctgtgggcagtgtgctggaagcttccctgagcaacagaccagaagagcctgcggaggccagcagcagccagattgccacagtgctgcggctgcttcgagtcatggagcatgtgcagaccaccctcctgctgggaaaactgccagggggccttccagccatgctggccaccccctccatctctgtgtacacaaacagaatacaaccctggagttggcaaggctcctccctgcgccctgatgccgcagactctgcaaccttcatgctgcccgctgcctcctccctcagctctctggagggcggccaggagcccgtggatataaagatcatgagtttcccaaagagcccctttccagcccgaagccactttgatgtcagcgggactgtcggtggcctccgtgtgaccagccctagtggtcaactcatacctgtgaagaatctgtcggagaatatcgagatcctgctgccccggcattcacaaagacacagccagccgaccgtgttgaacctgaccagtcctgaagctttgtgggtgaacgtgacttcaggggaggcaaccttggggatccagctgcactggagaccagacattgcactcacgcttagcctgggctatggctaccaccccaacaagagcagctacgatgcccaaactcacctcgtaccaatggtggctccagatgagctgcccacgtggatcctgagcccacaggacctgcgttttggagaaggggtctactatttgactgtggtccctgagtctgacctggagccagcccccggcagggacctcacggttggcatcaccaccttcctgtctcactgtgtgttctgggatgaggtccaggagacttgggacgactcaggatgccaggtggggcctcggaccagcccctaccagacacactgcctctgcaaccacctcactttcttcggaagcacgttcctggtgatgtccaatgccatcaacatccaccagactgctgagctctttgccacctttgaggacaaccctgtggtcgtgaccaccgtgggctgcctgtgtgtggtctacgtgctggtggtgatctgggcgaggaggaaggacgctcaggatcaggccaaggtgaaggtcacagtgctggaagacaatgatccctttgctcagtaccactacctggtgacagtctacacaggacaccgacgaggggcagccacgtcctcaaaggtgactgtcaccctgtatggcctggatggagagagagagccccaccacctggctgatcccgacactccggtttttgagcgaggagcagtggatgccttcctcctctccaccctgttccccctgggagaactgcggagcctccggctgtggcatgacaactcaggggaccggccatcgtggtatgtgagccgggtgctggtctatgacctggtgatggaccggaagtggtatttcctgtgcaactcctggctatccatcaatgttggagattgcgtcctcgataaggtgtttcctgtggccacggagcaggacagaaaacaattcagccacctgtttttcatgaagacttccgcgggcttccaggatggacacatctggtattcgatcttcagccgctgcgctcgcagcagcttcacccgcgtccagagggtgtcctgctgcttctccctgctgctgtgcaccatgctgaccagcatcatgttctggggggtccccaaggacccagctgagcaaaagatggacttgggtaaaattgaattcacctggcaggaggtgatgattggcctggagagctccatcctcatgttccccatcaacctcctgattgttcagatctttcagaacacccgtccccgggtcgcgaaggagcagaacactggaaaatgggaccgggggtcccccaacctgactccctccccacagcccatggaggacggccttctgacacctgaggcagtgaccaaggatgtgtcaagaatcgtcagctccctcttcaaagctctcaaggtgccatcccccgccttgggctgggactcagtgaacttgatggacatcaacagtctcctcgccttggtggaagatgtcatttatccacagaacacatcagggcaggtgttctgggaggaagccaaaaagagagaggaccctgtaacactcactttggggtcatcagaaatgaaagagaaatcacagtgtcccaagcccaaggcggcacggagtggcccctggaaggacagcgcctacaggcagtgtctgtaccttcagctggaacacgtggagcaagagctgcggctggtggggccccgaggcttctcccagccccacagccatgcccaggccctcaggcagctgcagaccctgaagggcggcctgggggtacagccgggcacctgggcccctgcacatgccagcgctcttcaggtgagcaaaccccctcaaggcctgccctggtggtgcatcctggtgggctggctcctggtagcggccaccagtggcgtggcggccttcttcaccatgctctacggcctgcactacgggagggccagctccctcaggtggctcatctccatggctgtctccttcgtggagagcatgttcgtcacccagcccctgaaggtgctgggattcgctgctttctttgcactggtcttgaagagagtggacgatgaggaggatactgtggccccgctgccaggacatctgttgggcccagacccctatgccttgttccgagcacgaagaaacagcagcagggatgtctaccagccacctctcaccgctgccattgagaagatgaaaaccacccacctcaaggaacagaaagcatttgccctcatcagagaaatcctggcatacttgggcttcctgtggatgctactgctcgtggcctacgggcagagggaccccagcgcctaccacctcaacagacacctccagcacagcttcaccaggggcttttcaggtgtgctcggcttccgagagttcttcaagtgggccaacaccaccctcgtgagtaacctgtatggtcaccccccaggctttatcactgatgggaactccaagctggttggcagtgcccagattcgtcaagtgagggtccaggaaagctcttgccctcttgcccagcagccgcaggcatatctcaacggatgccgtgcaccatattccctggatgctgaagacatggcagactatggggaaggctggaatgccaccaccctcagtaatggcagtaccagagccaggaccaacgtcaagggtatcccatctggggcaaactcactgtgtaccggggaggaggctacgtggtccccttggggactgatcgccaaagcacgtcaagaattctccgctatctctttgacaacacctggctggacgccctgaccagagctgtgtttgtggagtccactgtctacaacgccaacgtcaacctgttctgcattgtcacgctgacgctagagaccagcgctctgggcaccttttttacgcacgcggccctgcagagcctccgcctgtaccccttcaccgacggctggcaccccttcgtggtagcggcagagctcatctacttcctcttcctcctctactacatggtggtgcagggcaagcgcatgagtaaagagacgtggggctatttctgcagcaagtggaaccttctggagctggccatcatcctggccagctggagcgccctggcggtgtttgtgaagagggctgtcctggccgaaagggacctccagcgctgccggaaccacagggaggaaggcatcagcttcagtgagacagcagcagccgatgccgcccttggctacatcattgccttcctggtactcctgtccacagtgaagctttggcatctgctcaggttgaatcccaaaatgaacatgatcacggcagccctacgccgtgcctggggcgacatttcaggctttatgattgtcatccttaccatgctcctggcttactccatcgcgtcaaacttgatatttggttggaaactccgttcctacaaaaccctctttgatgcggcggagacgatggtcagccttcagctgggaatcttcaactacgaggaggtcctggactatagcccagtgcttggctccttcctcattggatcctgcattgtttttatgacatttgtggtgctgaacctgtttatctctgtcatcctggtggccttcagtgaggagcaaaaatactatcagctgtcggaggaaggggagatcgtagatttgctgctgatgaaaatactcagtttcctgggcattaagtctaagagagaggagcctggaagcagcagggagcagcctgggtctctgtcccagactcgccactctcgaccagcacaagctttgcccaaggactaagctgttcgtccacacgccaccatctaccagtggggacgcccagggcctcgggcgtacgcttaccagcgactctatagtctctctaggtcatagctttcatgtccattgaagaattaccaagcccagcaagtaaaaaaaattacaataacagagatatatgtaaaattgccaatactatgagagcttctttgttcaaatgtatttcctcttattataaataaaacaaatattaca

SEQ ID NO: 167276 - DNA, 1488 bp, Homo sapiens
  Payload ID: 12914
  Gene Symbol: PKD1L2
  Gene Name: polycystic kidney disease 1-like 2 (gene/pseudogene)
  Uniprot ID: Q7Z442
  ENST ID: ENST00000531391
  CDS Start-End: 117-1037
ccagatgatagcaatgcctcggggagcttcctcactctgtcctctgtctgcctttcagctgtgagaggaactgcaggccagttaatgccagcaaagacattctgctcagggtcaccatgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccaggggtcctgcatgggcgattcatgggaaggtgcccctcctgctgcccatgtatctcacgctaggtgagagggcctgtttgcccagactctcactcctgcatctgctggtgagcaagttgagggagtaactgaatctcattaatatttgggtggccaaatgtgagtccagacactgctactgactgcccatgttctcaacttcagtacatgccagcctgacatctggctgccagctcctgtgcttccttatccttctgggggtcttctctgaccctcagagcctactgtacctgcccatatggctgtgaattcatgcagtgttcagtgactaatgaagctggcttataaacaccccagctacctcacccctcttgatggataatcccaagcaggagtgaatcccaggtaatgggcttgatcacactcctgtactggcttccacccttccctgtctcacaccccctactccccacaagtgtttcttgggatcatgtccaaataaatgacttgctctcaaa

SEQ ID NO: 167277 - DNA, 2006 bp, Homo sapiens
  Payload ID: 12914
  Gene Symbol: PKD1L2
  Gene Name: polycystic kidney disease 1-like 2 (gene/pseudogene)
  ENST ID: ENST00000526632
  CDS Start-End: 1-1558
attggctcagggcaccccggaagagctgacctttgaggtggctggactcaatgcaaccttctcccacgagcaagtgagctttggagagccatttgggatttgccgcctggctgttccggttgaaggcacctttctggtcaccatgctggtgaggaatgccttctccaacctgagtttggaaatcgggaacatcactatcacagccccttccggtctccaagaaccatctgggatgaatgctgaaggaaagagtaaagataaaggcgatatggaggtgtacatccaacctggtccatatgtggatcctttcacgacagtgaccctgggctggccagacaatgacaaggagttacgcttccaatggtcatgtgggtcttgctgggctctgtggagcagctgtgttgagaggcagctgcttcgcacagaccagagggagctggtggttccagcatcctgcctgccgccgcctgactctgctgtcaccctgcgcctggctgttctgagaggccaagagctggagaacagggcagagcagtgcctctacgtgtctgcgccctgggaactcaggcctcgagtcagctgtgagaggaactgcaggccagttaatgccagcaaagacattctgctcagggtcaccatgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccaggggtcctgcatgggcgattcatgggaaggtgcccctcctgctgcccatgtatctcacgctaggtgagagggcctgtttgcccagactctcactcctgcatctgctggtgagcaagttgagggagtaactgaatctcattaatatttgggtggccaaatgtgagtccagacactgctactgactgcccatgttctcaacttcagtacatgccagcctgacatctggctgccagctcctgtgcttccttatccttctgggggtcttctctgaccctcagagcctactgtacctgcccatatggctgtgaattcatgcagtgttcagtgactaatgaagctggcttataaacaccccagctacctcacccctcttgatggataatcccaagcaggagtgaatcccaggtaatgggcttgatcacactcctgtactggcttccacccttccctgtctcacaccccctactccccacaagtgtttcttgggatcatgtccaaataaatgacttgctctc

SEQ ID NO: 167278 - DNA, 7621 bp, Homo sapiens
  Payload ID: 12914
  Gene Symbol: PKD1L2
  Gene Name: polycystic kidney disease 1-like 2 (gene/pseudogene)
  ENST ID: ENST00000614230
  CDS Start-End: 1-7377
atgagtgcagtgggcttggtactcctggtgcttgctctgaggcttagggccaccactgttaagccagaggaaggcagcttttgctctaacagccaggtggccttcagagatgcttgctatgaatttgtgccactcggacgcaccttccgtgatgcccagagctggtgcgaggggcaaggaggccatttggtcttcattcaggacgaaggcacccagtggtttctgcagaagcacatctcccaggacagggaatggtggattggactcacgtggaacttggcacggaatggaaccacggaggggccggggacttggttggacacctccaatgtgacctacagcaactggcatggagggcaggccgccgctgcccctgacacctgcggccacatcgggagaggcccttcctctgagtgggtgacctcggactgcgcccagaccttcgccttcatgtgcgagttccgggttggccagagcctggcctgcgagggactcaatgccaccgtgcactgtggcttggggcaggtcatccaggtccaggatgccgtctacgggcgccagaatccccatttctgcacccaggatgccgggcgtccttcagatctggagcagggatgcagctgggccaacgtcaaggaggaggtggcaggccagtgccaggagctacagtcatgccaggtggcagcagatgagacctactttggaaacctgtgtccgactcagggcagttacctgtgggtgcagtaccagtgccgggaagccctgcagctgatggtgtccagtgagagtttcatctttgacaatgtcaccatctccctgacgtggctcctctcaccctacataggaaacctgtcctgtataattagtacaggagacagccacacttttgatccctacaacccgccgagtgtgtccagcaatgtgacccaccagttcacatctcctggggaattcaccgtgtttgctgaatgcacaaccagtgagtggcatgtgacagctcagaggcaggtgaccgtgcgagacaagatggagacgctcagtgtgactgcatgctccggcctgtcccagtcaggagccggccctctctgccaggctgtctttggggatcctctgtggattcaggtggagcttgatggaggaacaggagtgacttacactgtgcttttgggtgacataaccctggccgagtccaccacccaaaagggctcgctaccgtacaatctgatcctggacagagaaacccagaaactgatgggccctgggaggcaccgcctggagatccaagccaccggcaacaccaccacctctacaatctccagaaacattacagtccacttggtggagctgctgtcagggctgcaggcctcctgggcttctgaccatttggagcttggacaggacctattgatcaccatctcattggctcagggcaccccggaagagctgacctttgaggtggctggactcaatgcaaccttctcccacgagcaagtgagctttggagagccatttgggatttgccgcctggctgttccggttgaaggcacctttctggtcaccatgctggtgaggaatgccttctccaacctgagtttggaaatcgggaacatcactatcacagccccttccggtctccaagaaccatctgggatgaatgctgaaggaaagagtaaagataaaggcgatatggaggtgtacatccaacctggtccatatgtggatcctttcacgacagtgaccctgggctggccagacaatgacaaggagttacgcttccaatggtcatgtgggtcttgctgggctctgtggagcagctgtgttgagaggcagctgcttcgcacagaccagagggagctggtggttccagcatcctgcctgccgccgcctgactctgctgtcaccctgcgcctggctgttctgagaggccaagagctggagaacagggcagagcagtgcctctacgtgtctgcgccctgggaactcaggcctcgagtcagctgtgagaggaactgcaggccagttaatgccagcaaagacattctgctcagggtcaccatgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccagtgggaggccagcttggctctacagcatgccagtgaggccctgttgacagtgagtgccaaggcccgccctgaggaccagaggcgccaggcagccaccagggacctgtttcaggctgtgggcagtgtgctggaagcttccctgagcaacagaccagaagagcctgcggaggccagcagcagccagattgccacagtgctgcggctgcttcgagtcatggagcatgtgcagaccaccctcctgctgggaaaactgccagggggccttccagccatgctggccaccccctccatctctgtgtacacaaacagaatacaaccctggagttggcaaggctcctccctgcgccctgatgccgcagactctgcaaccttcatgctgcccgctgcctcctccctcagctctctggagggcggccaggagcccgtggatataaagatcatgagtttcccaaagagcccctttccagcccgaagccactttgatgtcagcgggactgtcggtggcctccgtgtgaccagccctagtggtcaactcatacctgtgaagaatctgtcggagaatatcgagatcctgctgccccggcattcacaaagacacagccagccgaccgtgttgaacctgaccagtcctgaagctttgtgggtgaacgtgacttcaggggaggcaaccttggggatccagctgcactggagaccagacattgcactcacgcttagcctgggctatggctaccaccccaacaagagcagctacgatgcccaaactcacctcgtaccaatggtggctccagatgagctgcccacgtggatcctgagcccacaggacctgcgttttggagaaggggtctactatttgactgtggtccctgagtctgacctggagccagcccccggcagggacctcacggttggcatcaccaccttcctgtctcactgtgtgttctgggatgaggtccaggagacttgggacgactcaggatgccaggtggggcctcggaccagcccctaccagacacactgcctctgcaaccacctcactttcttcggaagcacgttcctggtgatgtccaatgccatcaacatccaccagactgctgagctctttgccacctttgaggacaaccctgtggtcgtgaccaccgtgggctgcctgtgtgtggtctacgtgctggtggtgatctgggcgaggaggaaggacgctcaggatcaggccaaggtgaaggtcacagtgctggaagacaatgatccctttgctcagtaccactacctggtgacagtctacacaggacaccgacgaggggcagccacgtcctcaaaggtgactgtcaccctgtatggcctggatggagagagagagccccaccacctggctgatcccgacactccggtttttgagcgaggagcagtggatgccttcctcctctccaccctgttccccctgggagaactgcggagcctccggctgtggcatgacaactcaggggaccggccatcgtggtatgtgagccgggtgctggtctatgacctggtgatggaccggaagtggtatttcctgtgcaactcctggctatccatcaatgttggagattgcgtcctcgataaggtgtttcctgtggccacggagcaggacagaaaacaattcagccacctgtttttcatgaagacttccgcgggcttccaggatggacacatctggtattcgatcttcagccgctgcgctcgcagcagcttcacccgcgtccagagggtgtcctgctgcttctccctgctgctgtgcaccatgctgaccagcatcatgttctggggggtccccaaggacccagctgagcaaaagatggacttgggtaaaattgaattcacctggcaggaggtgatgattggcctggagagctccatcctcatgttccccatcaacctcctgattgttcagatctttcagaacacccgtccccgggtcgcgaaggagcagaacactggaaaatgggaccgggggtcccccaacctgactccctccccacagcccatggaggacggccttctgacacctgaggcagtgaccaaggatgtgtcaagaatcgtcagctccctcttcaaagctctcaaggtgccatcccccgccttgggctgggactcagtgaacttgatggacatcaacagtctcctcgccttggtggaagatgtcatttatccacagaacacatcagggcaggtgttctgggaggaagccaaaaagagagaggaccctgtaacactcactttggggtcatcagaaatgaaagagaaatcacagtgtcccaagcccaaggcggcacggagtggcccctggaaggacagcgcctacaggcagtgtctgtaccttcagctggaacacgtggagcaagagctgcggctggtggggccccgaggcttctcccagccccacagccatgcccaggccctcaggcagctgcagaccctgaagggcggcctgggggtacagccgggcacctgggcccctgcacatgccagcgctcttcaggtgagcaaaccccctcaaggcctgccctggtggtgcatcctggtgggctggctcctggtagcggccaccagtggcgtggcggccttcttcaccatgctctacggcctgcactacgggagggccagctccctcaggtggctcatctccatggctgtctccttcgtggagagcatgttcgtcacccagcccctgaaggtgctgggattcgctgctttctttgcactggtcttgaagagagtggacgatgaggaggatactgtggccccgctgccaggacatctgttgggcccagacccctatgccttgttccgagcacgaagaaacagcagcagggatgtctaccagccacctctcaccgctgccattgagaagatgaaaaccacccacctcaaggaacagaaagcatttgccctcatcagagaaatcctggcatacttgggcttcctgtggatgctactgctcgtggcctacgggcagagggaccccagcgcctaccacctcaacagacacctccagcacagcttcaccaggggcttttcaggtgtgctcggcttccgagagttcttcaagtgggccaacaccaccctcgtgagtaacctgtatggtcaccccccaggctttatcactgatgggaactccaagctggttggcagtgcccagattcgtcaagtgagggtccaggaaagctcttgccctcttgcccagcagccgcaggcatatctcaacggatgccgtgcaccatattccctggatgctgaagacatggcagactatggggaaggctggaatgccaccaccctcagttggcagtaccagagccaggaccaacgtcaagggtatcccatctggggcaaactcactgtgtaccggggaggaggctacgtggtccccttggggactgatcgccaaagcacgtcaagaattctccgctatctctttgacaacacctggctggacgccctgaccagagctgtgtttgtggagtccactgtctacaacgccaacgtcaacctgttctgcattgtcacgctgacgctagagaccagcgctctgggcaccttttttacgcacgcggccctgcagagcctccgcctgtaccccttcaccgacggctggcaccccttcgtggtagcggcagagctcatctacttcctcttcctcctctactacatggtggtgcagggcaagcgcatgagtaaagagacgtggggctatttctgcagcaagtggaaccttctggagctggccatcatcctggccagctggagcgccctggcggtgtttgtgaagagggctgtcctggccgaaagggacctccagcgctgccggaaccacagggaggaaggcatcagcttcagtgagacagcagcagccgatgccgcccttggctacatcattgccttcctggtactcctgtccacagtgaagctttggcatctgctcaggttgaatcccaaaatgaacatgatcacggcagccctacgccgtgcctggggcgacatttcaggctttatgattgtcatccttaccatgctcctggcttactccatcgcgtcaaacttgatatttggttggaaactccgttcctacaaaaccctctttgatgcggcggagacgatggtcagccttcagctgggaatcttcaactacgaggaggtcctggactatagcccagtgcttggctccttcctcattggatcctgcattgtttttatgacatttgtggtgctgaacctgtttatctctgtcatcctggtggccttcagtgaggagcaaaaatactatcagctgtcggaggaaggggagatcgtagatttgctgctgatgaaaatactcagtttcctgggcattaagtctaagagagaggagcctggaagcagcagggagcagcctgggtctctgtcccagactcgccactctcgaccagcacaagctttgcccaaggactaagctgttcgtccacacgccaccatctaccagtggggacgcccagggcctcgggcgtacgcttaccagcgactctatagtctctctaggtcatagctttcatgtccattgaagaattaccaagcccagcaagtaaaaaaaattacaataacagagatatatgtaaaattgccaatactatgagagcttctttgttcaaatgtatttcctcttattataaataaaacaaatattacatggagtttgg

SEQ ID NO: 167279 - DNA, 5199 bp, Homo sapiens
  Payload ID: 12915
  Gene Symbol: PKD1L3
  Gene Name: polycystic kidney disease 1-like 3
  Uniprot ID: Q7Z443
  ENST ID: ENST00000620267
  CDS Start-End: 1-5199
atgttcttcaaaggaggaagctggctttggttatacatcagaacaagtattattctaggaagtgagctaaacagcccagcaccacatgggcaaaataattgttaccagcttaacagatttcaatgcagctttgaggaagcacagcattactgtcatgtgcagagaggattcctagctcatatttggaacaaggaagttcaagatctcatccgggactatctggaagaaggaaagaagtggtggattgggcaaaatgtaatgccattgaaaaagcatcaagacaacaaatacccagcagacgttgcagccaacgggcccccaaagcccctcagctgcacctacctgtccagaaacttcattcggatctcatccaaaggggacaagtgcttactgaaatactatttcatttgccagactggtgactttttggacggagatgcccattatgaaagaaatggaaataattcccatttgtaccagagacacaagaagacaaaaagaggagttgcaatagcaagagacaaaatgcccccaggacctggtcatcttccaaccacatgtcactatcctcttcctgctcatctttccaagaccctgtgtcatcccatcagccagtttccttcagtactatcaagtatcacatcacaggtaacatcagccgcatctgaacccagcagccagcctctccctgtgataacacagctcaccatgcccgtgtctgtcacgcatgctgggcaatctctggcagaaacaacttcaagcccaaaggaagaaggtcatccgaataccttcacctcttatctacaagtgtcattgcagaaggcatctggtcaggtcatagatgagatagcagggaacttcagcagagcagttcatggtttgcaagctcttaacaaactacaggaagcttgtgagttcctccagaaactaacagccttaaccccaagattttctaagccagctcaggttaatctcatcaattcccttatttacctgagtgaggagttactcaggatcccatttcagaacaacaacagtctgggcttcaaagttcctccaactgtctgcccctttcattccctcaacaatgtcaccaaagctggagaaggaagttggctggaatccaagcgtcatactgagccggtagaagacatcctggaaatgtccttggtggagtttgggaatatcggggaagcatttctagagcagaaccagtctcccgagtcttcagtgactttgacctctgccaatgctactctgctgctgagcagacaaaacatatcaactttaccgctgagctcttacactctgggtcacccagcccctgtgaggctaggctttccgtcggctttagctttgaaggagctcttgaataaacatccaggagttaatgtccaaataacaggactagctttcaatcccttcaaggatttggacaacagaaacattgttggaagcattggaagtgtgttactaagcgctaatcgtaaattgctccaagtccatgatttaatggaggacattgagatcatgctctggagaaatgttagcttggaaacccatcccaccagcctcaacatgagcacacatcagcttacaatcacagtgaacgtcacttccttggagaaatccttgatagtgagcatagatcctgacagtccccttttaatgacactctacctggggttccagtatcagcctaactgcactcacttccacctgaacatcacccttccaaaggataaggtgtggcaaaaagatgaggagtacacgtgggtgctgaatccagagcatctgcagcacgggattggcacctactatataacagctgtgctgagtgagaggcaggagggtgctcagcagacacccagcttggtctcggtcatcaccgccgtcactcagtgttactactgggagatccacaaccagacatggagcagcgccggatgccaagttgggccacagagcacaattctgaggacacagtgtctctgtaaccacctgaccttctttgccagcgacttctttgtcgtgcccaggaccgtgaatgttgaagacacgatcaaactgttccttcgcgtgaccaacaatcctgttggggtgtcactgctggccagccttttaggattttatgtgatcacagttgtgtgggctcggaaaaaggatcaagcagatatgcagaaggtgaaggtcactgtcctggctgataatgaccccagcgctcaatttcactaccttattcaggtctacaccggatatcgaagaagcgctgctacaacagctaaggttgtcatcaccctctatggatcagagggacggagtgagccccatcacctctgtgacccccagaagacagtctttgaacgagggggcctggatgtcttccttctcaccacttggacctctctagggaacctgcacagccttcggctctggcatgacaattctggcgtcagtccctcctggtatgtcagccaggtaattgtctgtgacatggcagttaagaggaagtggcatttcctgtgcaattgctggctggctgtggacctcggagactgtgagcttgaccgggtcttcatcccagtttcaaagagagagctcttttcctttagacatctgttttcctccatgattgtggaaaagttcacccaggattatctgtggctttcaattgcaactcggcatccctggaaccagtttacaagggtccaacggctgtcttgctgcatgacactgctactctgcaacatggtcatcaatgttatgttctggaagataaacagcaccactgccaagagagatgagcaaatgcgtccatttgctgtggcctggtctgaactgctggtcagcatccatactgctgtcatcctcttcccaatcaatcttgtcatagggcggctcttcccgttgattgagccacaggagactctgcccctctttcctcccatccaggcctcctgcctctcagatgcttctgttgagcctctctctgccacaatggtagttgaggaattaaaggaaactgtgagattcctgctcaggagaaatacatacctactctccaagtgtgagcagccgccatggagttcttgggacattactaagctggtgaaacttttatccagcctcgtatcatctcacttggagggtcaaggctgtcatcagcagggagagcgccactgggcacgtgttgttcctgaaaaccaccatcatttctgctgttacctgcatagagttctgcagaggctgaaatctcacttaggcacgctgggtctcacccagggtcaccagtcctgtgacttcctagatgcagccagccaacttcaaaaactccaggaactcttggaaacacatattcttcccacggagcaagagccatccagggaagtcaccagttttgccatcctgagctcagaagaaggaaaaaagcccatctcaaatggcctgtccaaatggttgacttcagtctgctggctcctcttaggtttcactagcctggcttcagccttttttacagcactttatagcttggaattgagcaaagaccaagccaccagctggatgatttcaattattttatcagtgcttcagaacatcttcatcagccagccagtaaaggtggtcttcttcacattcttatactcactgatgatgagcaggatgccacggcttaacaaagagaatgaacaacaaacaaagaggatcttggcactcttggcaaaatgttcttcgtcagtaccaggttcaagagataagaacaaccccgtctatgtagccccagctataaatagtccaactaagcacccagaaagaaccttgaaaaagaagaaactcttcaagctgactggagatattttggtacaaatcctcttccttaccctgttgatgactgcaatctactctgcaaagaactccaatagattttacctccaccaagctatctggaagacattttcgcaccagttctcggaaatcaaacttcttcaggatttctacccctgggccaatcatatccttcttcctagcctgtatggggattacagaggtaagaatgcagtcctggagcccagtcattgcaaatgtggggtacaattaattttccaaataccccgtaccaagacctatgagaaagtggacgaaggtcagctggcgttttgtgataacggccatacctgtgggcgtcccaagagcctattccctggacttcatctaaggaggttcagttacatctgttcacccaggcccatggtgctgattcccactgatgagcttcacgaaaggctgacaagcaagaatgagaatggattcagttacatcatgagaggtgctttcttcacctctttgagactggaaagcttcacttcccttcagatgtcaaagaagggctgtgtctggtctatcatctcacaagtcatctattatctactggtctgttactatgccttcatacagggttgtcagctgaaacagcagaagtggaggttcttcactgggaaaagaaacattctggacacaagtataatcctcattagcttcatcctcctggggcttgacatgaagagtatttctctacataagaaaaacatggcacgataccgcgatgaccaggacagattcatcagcttctatgaggcagtaaaagtgaactctgctgcgactcaccttgtgggcttcccggttctcctggcaactgttcagttatggaacctgctgcgtcatagccccaggctgcgggtcatcagcaggacactgagccgagcctgggacgaggtggtgggctttctgctgatcatcctaatcctgctgacaggctatgccattgcctttaacctgctgtttggatgcagcatctctgactaccggacatttttcagctcagcagtgactgttgttggtctcctgatgggaatttctcaccaagaggaggttttcgctttagacccagtcctgggcacctttctgatcctcaccagtgtcatcttgatggtacttgtggtaattaatcttttcgtttcggccattctcatggcctttggaaaagaaagaaagtcgcttaagaaagaagctgcactaatagatacactgctacagaagctctcaaatttgttaggaatcagttggccccaaaaaacctcatctgagcaagcagccacgacagcagtgggcagtgacactgaagttttagatgaactaccttaa

SEQ ID NO: 167280 - DNA, 5056 bp, Homo sapiens
  Payload ID: 12916
  Gene Symbol: PKD2
  Gene Name: polycystic kidney disease 2 (autosomal dominant)
  Uniprot ID: Q13563
  ENST ID: ENST00000237596
  CDS Start-End: 67-2973
ggctcctgaggcgcacagcgccgagcgcggcgccgcgcacccgcgcgccggacgccagtgaccgcgatggtgaactccagtcgcgtgcagcctcagcagcccggggacgccaagcggccgcccgcgccccgcgcgccggacccgggccggctgatggctggctgcgcggccgtgggcgccagcctcgccgccccgggcggcctctgcgagcagcggggcctggagatcgagatgcagcgcatccggcaggcggccgcgcgggaccccccggccggagccgcggcctccccttctcctccgctctcgtcgtgctcccggcaggcgtggagccgcgataaccccggcttcgaggccgaggaggaggaggaggaggtggaaggggaagaaggcggaatggtggtggagatggacgtagagtggcgcccgggcagccggaggtcggccgcctcctcggccgtgagctccgtgggcgcgcggagccgggggcttgggggctaccacggcgcgggccacccgagcgggaggcggcgccggcgagaggaccagggcccgccgtgccccagcccagtcggcggcggggacccgctgcatcgccacctccccctggaagggcagccgccccgagtggcctgggcggagaggctggttcgcgggctgcgaggtctctggggaacaagactcatggaggaaagcagcactaaccgagagaaataccttaaaagtgttttacgggaactggtcacatacctcctttttctcatagtcttgtgcatcttgacctacggcatgatgagctccaatgtgtactactacacccggatgatgtcacagctcttcctagacacccccgtgtccaaaacggagaaaactaactttaaaactctgtcttccatggaagacttctggaagttcacagaaggctccttattggatgggctgtactggaagatgcagcccagcaaccagactgaagctgacaaccgaagtttcatcttctatgagaacctgctgttaggggttccacgaatacggcaactccgagtcagaaatggatcctgctctatcccccaggacttgagagatgaaattaaagagtgctatgatgtctactctgtcagtagtgaagatagggctccctttgggccccgaaatggaaccgcttggatctacacaagtgaaaaagacttgaatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcaggttattggttgaattcccagcaacaggtggtgtgattccatcttggcaatttcagcctttaaagctgatccgatatgtcacaacttttgatttcttcctggcagcctgtgagattatcttttgtttctttatcttttactatgtggtggaagagatattggaaattcgcattcacaaactacactatttcaggagtttctggaattgtctggatgttgtgatcgttgtgctgtcagtggtagctataggaattaacatatacagaacatcaaatgtggaggtgctactacagtttctggaagatcaaaatactttccccaactttgagcatctggcatattggcagatacagttcaacaatatagctgctgtcacagtattttttgtctggattaagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatcttcactcaattccgtatcattttgggcgatatcaactttgcagagattgaggaagctaatcgagttttgggaccaatttatttcactacatttgtgttctttatgttcttcattcttttgaatatgtttttggctatcatcaatgatacttactctgaagtgaaatctgacttggcacagcagaaagctgaaatggaactctcagatcttatcagaaagggctaccataaagctttggtcaaactaaaactgaaaaaaaataccgtggatgacatttcagagagtctgcggcaaggaggaggcaagttaaactttgacgaacttcgacaagatctcaaagggaagggccatactgatgcagagattgaggcaatattcacaaagtacgaccaagatggagaccaagaactgaccgaacatgaacatcagcagatgagagacgacttggagaaagagagggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttacccatggttcaaagatttttttttctttttctcatataagaaatctaggtgtaaatattgagtacagaaaaaaaatcttcatgatgtgtattgagcggtacgcccagttgccaccatgactgagtcttctcagttgacaatgaagtagccttttaaagctagaaaactgtcaaagggcttctgagtttcatttccagtcacaaaaatcagtattgttatttttttccaagagtgtgaaggaaaatggggcattcctttccactctggcatagttcatgagcttaatacatagctttcttttaagaaaggagccttttttttcaactagcttcctggggtaaacttttctaaaagataaaatggaaaggaactccaaactatgatagaatctgtgtgaatggttaagatgaatgttaaatactatgcttttttgtaagttgatcgtatctgatgtctgtgggactaactgtatcacttaatttttaccttattttggctctaatttgaataagctgagtaaaaccaccaaagatcagttataggataaaatggcatctctaaccataacacaggagaattggaaggagccctaagttgtcactcagtttaatttcttttaatggttagtttagcctaaagatttatctgcatattctttttcccatgtggctctactcatttgcaactgaatttaatgttataactcatctagtgagaccaacttactaaatttttagtatgcactgaaagtttttatccaacaattatgttcattttaagcaaaattttaagaaagttttgaaattcataaagcatttggttttaaactattttaagaatatagtactcggtcaggtatgacggctcacgcctgtaatcccagcactttgggaggccgaaacaggcgaatcacttgagcccaggagttcaagaccaacatgggcaatgtggcgaaactccatctctacaaaaaatgcaaaaataaaaaatatagtactcaagtattcttgatcctgtgtttcaaaactagaatttgtaatgcaaatggagctcagtctaataaaaaagaggttttggtattaaaagttcatacattagacagtatcagccaaaatttgagttagcaacactgttttctttacgagagggtctcacccaaatttatggggagaaatctatttctcaaaaaaaaaaatcttcttttacagaaatgttgagtaaggtgacattttgagcgctaataagcaaaagagcatgcagtgctgttgaataaccctcacttggagaaccaagagaatcctgtcgtttaatgctatattttaatttcacaagttgttcatttaactggtagaatgtcagtccaatctccaatgagaacatgagcaaatagacctttccaggttgaaagtgaaacatactgggtttctgtaagtttttcctcatggcttcatctctatctttactttctcttgaatatgctacacaaagttctttattactacatactaaagtttgcattccagggatattgactgtacatatttatgtatatgtaccatgttgttacatgtaaacaaacttcaatttgaagtgcagctattatgtggtatccatgtgtatcgaccatgtgccatatatcaattatggtcactagaaagtctctttatgatactttttattgtactgtttttcatttcacttgcaaaattttgcagaattcctcctttctacccataaattacatatatttttcttctttagtcatggagaactccccccctcatctcttccctattatctttccctgtgtactggtattattaaaaagacattacatacgcaagtctttctcgacaatcaagaatgttattaatgtgtaatactgagcactttacttcttaataaaaacttgatatagtagca

SEQ ID NO: 167281 - DNA, 1222 bp, Homo sapiens
  Payload ID: 12916
  Gene Symbol: PKD2
  Gene Name: polycystic kidney disease 2 (autosomal dominant)
  ENST ID: ENST00000502363
  CDS Start-End: 51-1211
atgtcttctctctcttacagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatcttcactcaattccgtatcattttgggcgatatcaactttgcagagattgaggaagctaatcgagttttgggaccaatttatttcactacatttgtgttctttatgttcttcattcttttgaatatgtttttggctatcatcaatgatacttactctgaagtgaaatctgacttggcacagcagaaagctgaaatggaactctcagatcttatcagaaagggctaccataaagctttggtcaaactaaaactgaaaaaaaataccgtggatgacatttcagagagtctgcggcaaggaggaggcaagttaaactttgacgaacttcgacaagatctcaaagggaagggccatactgatgcagagattgaggcaatattcacaaagtacgaccaagatggagaccaagaactgaccgaacatgaacatcagcagatgagagacgacttggagaaagagagggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgttt

SEQ ID NO: 167282 - DNA, 1720 bp, Homo sapiens
  Payload ID: 12916
  Gene Symbol: PKD2
  Gene Name: polycystic kidney disease 2 (autosomal dominant)
  ENST ID: ENST00000508588
  CDS Start-End: 396-1556
aatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcagctgtcagtggtagctataggaattaacatatacagaacatcaaatgtggaggtgctactacagtttctggaagatcaaaatactttccccaactttgagcatctggcatattggcagatacagttcaacaatatagctgctgtcacagtattttttgtctggattaagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatcttcactcaattccgtatcattttgggcgatatcaactttgcagagattgaggaagctaatcgagttttgggaccaatttatttcactacatttgtgttctttatgttcttcattcttttgaatatgtttttggctatcatcaatgatacttactctgaagtgaaatctgacttggcacagcagaaagctgaaatggaactctcagatcttatcagaaagggctaccataaagctttggtcaaactaaaactgaaaaaaaataccgtggatgacatttcagagagtctgcggcaaggaggaggcaagttaaactttgacgaacttcgacaagatctcaaagggaagggccatactgatgcagagattgaggcaatattcacaaagtacgaccaagatggagaccaagaactgaccgaacatgaacatcagcagatgagagacgacttggagaaagagagggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttaccca

SEQ ID NO: 167283 - DNA, 3043 bp, Homo sapiens
  Payload ID: 12917
  Gene Symbol: PKD2L1
  Gene Name: polycystic kidney disease 2-like 1
  Uniprot ID: Q9P0L9
  ENST ID: ENST00000318222
  CDS Start-End: 384-2801
cagcatcgccttttcctcccgtttctccttccactcccagctccacatcctcctcctattctcccctctcccctcttcaaacccccaccttccagttccctcacctcccctttcggctggtcccctggggcttgcagcaagagggagagagagctcctgacaggattgatggtccttccccaccctgtcctctcatccgctccctccccagcaggcacagacatccccctacaaaaggcaggagcccaggctgtgtggaaacagctgctctcagacgcctttccatttgctctctgctggctaggctgggctgtgcctctgctccctcttcctctagctgagagtgggcacctggggtaccgggcccccccacctcattccccatgaatgctgtgggaagtcctgaggggcaggagctgcaaaagctggggagtggagcctgggacaaccccgcctacagtggtcccccttccccacacgggacgctgagagtctgcaccatctccagcacggggcctctccagccccaacccaagaagcctgaagatgaaccccaggagacggcatacaggacccaggtgtccagctgctgcctccatatctgtcaaggcatcagaggactttggggaacaaccctgactgagaacacagctgagaaccgggaactttatatcaagaccaccctgagggagctgttggtatatattgtgttcctggtggacatctgtctactgacctatggaatgacaagctccagtgcttattactacaccaaagtgatgtctgagctcttcttacatactccatcagacactggagtctcctttcaggccatcagcagcatggcggacttctgggattttgcccagggcccactactggacagtttgtattggaccaaatggtacaacaaccagagcctgggccatggctcccactccttcatctactatgagaacatgctgctgggggttccgaggctgcggcagctaaaggtccgcaatgactcctgtgtggtgcatgaagacttccgggaggacattctgagctgctatgatgtctactctccagacaaagaagaacaactcccctttgggcccttcaatggcacagcgtggacataccactcgcaggatgagttggggggcttctcccactggggcaggctcacaagctacagcggaggtggctactacctggaccttccaggatcccgacagggtagtgcagaggctctccgggcccttcaggaggggctgtggctggacaggggcactcgagtggtgttcatcgacttctcagtctacaatgccaatatcaatcttttctgtgtcctgaggctggtggtggagtttccagctacaggaggtgccatcccatcctggcaaatccgcacagtcaagctgatccgctatgtcagcaactgggacttctttatcgttggctgtgaggtcatcttctgcgtcttcatcttctactatgtggtggaagagatcctggagctccacattcaccggcttcgctacctcagcagcatctggaacatactggacctggtggtcatcttgctctccattgtggctgtgggcttccacatattccgaaccctcgaggtgaatcggctcatggggaagctcctgcagcagccaaacacgtatgcagactttgagttcctcgccttctggcagacacagtacaacaacatgaatgctgtcaacctcttcttcgcctggatcaagatattcaagtacatcagcttcaacaaaaccatgacccagctctcctccacgctggcccgctgtgccaaggacatcctgggcttcgccgtcatgttcttcattgttttcttcgcctatgcccaactcggctacctgcttttcgggacccaagtggaaaactttagcactttcatcaagtgcattttcactcagttccggataatcctcggggactttgactacaatgctatcgacaatgccaaccgcatcctgggccctgcctactttgtcacctatgtcttcttcgtcttcttcgtgctcctgaacatgttcctggccatcatcaatgacacatattcagaggtcaaggaggagctggctggacagaaggatgagctgcaactttctgacctcctgaaacagggctacaacaagaccctactaagactgcgtctgaggaaggagagggtttcggatgtgcagaaggtcctgcagggtggggagcaggagatccagtttgaggatttcaccaacaccttaagggaactgggacacgcagagcatgaaatcactgagctcacggccaccttcaccaagtttgacagagatgggaatcgtattctggatgagaaggaacaggaaaaaatgcgacaggacctggaggaagagagggtggccctcaacactgagattgagaaactaggccgatctattgtgagcagcccacaaggcaaatcgggtccagaggctgccagagcaggaggctgggtttcaggagaagaattctacatgctcacaaggagagttctgcagctggagactgtcctggaaggagtagtgtcccagattgatgctgtaggctcaaagctgaaaatgctggagaggaaggggtggctggctccctccccaggcgtgaaggaacaagctatttggaagcacccgcagccagccccagctgtgaccccagacccctggggagtccagggtgggcaggagagtgaggttccctataaaagagaagaggaagccttagaggagaggagactctcccgtggtgagattccaacgttgcagaggagttaagtgtgaggcactcccggagcaaagtctatgaaggatcttctgcaagaggctgcctcctggtccactgaacctggaaactgagtgggctttaaccaggagataaaaatggagcctgaagggaatcaggcaaggaaatgaactcaggattcagagatctttgaattaatatgtggtgggttctgacattattcttccataagaccatgtgggtttccatggtggctatcaataaaactccttag

SEQ ID NO: 167284 - DNA, 423 bp, Homo sapiens
  Payload ID: 12917
  Gene Symbol: PKD2L1
  Gene Name: polycystic kidney disease 2-like 1
  ENST ID: ENST00000465680
  CDS Start-End: 1-187
gcctctccagccccaacccaagaagcctgaagatgaaccccaggagacggcatacaggacccaggtgtccagctgctgcctccatatctgtcaaggcatcagagaggttccctataaaagagaagaggaagccttagaggagaggagactctcccgtggtgagattccaacgttgcagaggagttaagtgtgaggcactcccggagcaaagtctatgaaggatcttctgcaagaggctgcctcctggtccactgaacctggaaactgagtgggctttaaccaggagataaaaatggagcctgaagggaatcaggcaaggaaatgaactcaggattcagagatctttgaattaatatgtggtgggttctgacattattcttccataagaccatgtgggtttccatggtggctatcaataaaact

SEQ ID NO: 167285 - DNA, 554 bp, Homo sapiens
  Payload ID: 12917
  Gene Symbol: PKD2L1
  Gene Name: polycystic kidney disease 2-like 1
  ENST ID: ENST00000532547
  CDS Start-End: 162-377
atccccctacaaaaggcaggagcccaggctgtgtggaaacagctgctctcagacgcctttccatttgctctctgctggctaggctgggctgtgcctctgctccctcttcctctagctgagagtgggcacctggggtaccgggcccccccacctcattccccatgaatgctgtgggaagtcctgaggggcaggagctgcaaaagctggggagtggagcctgggacaaccccgcctacagtggtcccccttccccacacgggacgctgagagtctgcaccatctccagcacggggcctctccagccccaacccaagaagcctgaagatgaaccccaggagacggcatacaggacccaggactttggggaacaaccctgactgagaacacagctgagaaccgggaactttatatcaagaccaccctgagggagctgttggtatatattgtgttcctggtggacatctgtctactgacctatggaatgacaagctccagtgcttattactacaccaaagtgatgtctgagctcttcttacatactccatcagacactg

SEQ ID NO: 167286 - DNA, 2277 bp, Homo sapiens
  Payload ID: 12917
  Gene Symbol: PKD2L1
  Gene Name: polycystic kidney disease 2-like 1
  ENST ID: ENST00000528248
  CDS Start-End: 1-119
atgaaccccaggagacggcatacaggacccaggtgtccagctgctgcctccatatctgtcaaggcatcagaggcatctctcccatgccccttaggactttggggaacaaccctgactgagaacacagctgagaaccgggaactttatatcaagaccaccctgagggagctgttggtatatattgtgttcctggtggacatctgtctactgacctatggaatgacaagctccagtgcttattactacaccaaagtgatgtctgagctcttcttacatactccatcagacactggagtctcctttcaggccatcagcagcatggcggacttctgggattttgcccagggcccactactggacagtttgtattggaccaaatggtacaacaaccagagcctgggccatggctcccactccttcatctactatgagaacatgctgctgggggttccgaggctgcggcagctaaaggtccgcaatgactcctgtgtggtgcatgaagacttccgggaggacattctgagctgctatgatgtctactctccagacaaagaagaacaactcccctttgggcccttcaatggcacagcgtggacataccactcgcaggatgagttggggggcttctcccactggggcaggctcacaagctacagcggaggtggctactacctggaccttccaggatcccgacagggtagtgcagaggctctccgggcccttcaggaggggctgtggctggacaggggcactcgagtggtgttcatcgacttctcagtctacaatgccaatatcaatcttttctgtgtcctgaggctggtggtggagtttccagctacaggaggtgccatcccatcctggcaaatccgcacagtcaagctgatccgctatgtcagcaactgggacttctttatcgttggctgtgaggtcatcttctgcgtcttcatcttctactatgtggtggaagagatcctggagctccacattcaccggcttcgctacctcagcagcatctggaacatactggacctggtggtcatcttgctctccattgtggctgtgggcttccacatattccgaaccctcgaggtgaatcggctcatggggaagctcctgcagcagccaaacacgtatgcagactttgagttcctcgccttctggcagacacagtacaacaacatgaatgctgtcaacctcttcttcgcctggatcaagatattcaagtacatcagcttcaacaaaaccatgacccagctctcctccacgctggcccgctgtgccaaggacatcctgggcttcgccgtcatgttcttcattgttttcttcgcctatgcccaactcggctacctgcttttcgggacccaagtggaaaactttagcactttcatcaagtgcattttcactcagttccggataatcctcggggactttgactacaatgctatcgacaatgccaaccgcatcctgggccctgcctactttgtcacctatgtcttcttcgtcttcttcgtgctcctgaacatgttcctggccatcatcaatgacacatattcagaggtcaaggaggagctggctggacagaaggatgagctgcaactttctgacctcctgaaacagggctacaacaagaccctactaagactgcgtctgaggaaggagagggtttcggatgtgcagaaggtcctgcagggtggggagcaggagatccagtttgaggatttcaccaacaccttaagggaactgggacacgcagagcatgaaatcactgagctcacggccaccttcaccaagtttgacagagatgggaatcgtattctggatgagaaggaacaggaaaaaatgcgacaggacctggaggaagagagggtggccctcaacactgagattgagaaactaggccgatctattgtgagcagcccacaaggcaaatcgggtccagaggctgccagagcaggaggctgggtttcaggagaagaattctacatgctcacaaggagagttctgcagctggagactgtcctggaaggagtagtgtcccagattgatgctgtaggctcaaagctgaaaatgctggagaggaaggggtggctggctccctccccaggcgtgaaggaacaagctatttggaagcacccgcagccagccccagctgtgaccccagacccctggggagtccagggtgggcaggagagtgaggttccctataaaagagaagaggaagccttagaggagaggagactctcccgtggtgagattccaacgttgcagaggagttaa

SEQ ID NO: 167287 - DNA, 2202 bp, Homo sapiens
  Payload ID: 12918
  Gene Symbol: PKD2L2
  Gene Name: polycystic kidney disease 2-like 2
  Uniprot ID: Q9NZM6
  ENST ID: ENST00000290431
  CDS Start-End: 24-1865
gggcggtgtagtgcaggtccgccatggctgaggcgtcacggtggcaccgaggcggggcttcgaaacataagttgcattacagaaaggaagtagaaattacaaccacacttcaggaattgttactctactttatttttttaataaacctatgtatattgacttttgggatggtaaacccacatatgtattacttaaacaaggttatgtcatctctatttttggacacttctgtgcctggtgaagaaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatactgaatggagatattctacttctaataccaactccccttggcactggggatttcttggtgtttaccgaaatgggggatacattttcactttatcaaaatcgaaatctgaaaccaaaaacaagttcattgaccttcgactgaacagctggatcacaagagggactagagttatttttattgatttttccttatataatgctaatgtaaatctattttgtattatcagattggtggcagaattccctgcaactggaggaatacttacttcatggcagttttactctgtgaagctcctcagatatgttagctactatgactattttattgcttcctgtgaaatcacattctgtatttttctttttgtcttcacaacacaagaagtcaaaaaaataaaagaatttaagtctgcctatttcaaaagtatttggaactggctagaattgctacttttgctgttgtgttttgtggctgtttccttcaacacatactataatgtacaaatttttctcttacttggacagctgttgaaaagtactgaaaaatattcagatttctattttcttgcatgctggcacatttattacaataatataattgctattaccatcttttttgcatggataaagatattcaaattcataagctttaacaagacaatgtctcagctgtcatcaaccttgtcccgttgtgttaaagacatagtaggatttgccatcatgttttttataatattctttgcttatgcccagttaggatttcttgtttttggatcacaagttgatgacttttccacttttcagaattccatatttgcacaatttcgaattgttcttggagattttaattttgctggtattcagcaagccaatcctatcttgggacccatttacttcatcactttcatcttttttgtgttctttgtcctgctgaatatgttcttggcaattattaatgatacctattctgaagtgaaagctgactattcaataggcagaaggctagattttgaacttggcaaaatgattaaacagagttacaaaaatgttctcgagaaattcagactgaagaaagctcaaaaagatgaagacaagaaaaccaaaggcagcggagatttggctgaacaagccagaagagaaggctttgacgaaaatgagattcaaaacgcagagcagatgaaaaaatggaaagagaggcttgagaaaaagtattattctatggaaattcaagatgactaccagcctgtcactcaagaagaatttcgagatggcaccacaaccaagtacaaaatgagattctctgagtgcctgacaaaacgaatttaagtaccagccaagtacacacgatgatagcttcaaggaatacaactgactttatgatatgaattttcaaggaacgtatcttatatggattttgaagaatcttgtttgcttataagaacttcaagaagcctaagcttggctttaattttcttgtactctctgtactcctcaagcactggaacacgatcctctttctgggcattcctaggggagaaaataaaatttgtaatgttctagagatcatttggaaaaaaagatccaaaagttgtcttaatatgagacatactgttactaaacataagttcaaataaaaagttgttctgttaaaaaaaaaaaaaaa

SEQ ID NO: 167288 - DNA, 930 bp, Homo sapiens
  Payload ID: 12918
  Gene Symbol: PKD2L2
  Gene Name: polycystic kidney disease 2-like 2
  Uniprot ID: Q9NZM6
  ENST ID: ENST00000414094
  CDS Start-End: 35-208
ggcgaacgaacgggcggtgtagtgcaggtccgccatggctgaggcgtcacggtggcaccgaggcggggcttcgaaacataagttgcattacagaaaggaagtagaaattacaaccacacttcaggaattgttactctactttatttttttaataaacctatgtatatgttatgtcatctctatttttggacacttctgtgcctggtgaagaaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatactgaatggagatattctacttctaataccaactccccttggcactggggatttcttggtgtttaccgaaatgggggatacattttcactttatcaaaatcgaaatctgaaaccaaaaacaagttcattgaccttcgactgaacagctggatcacaagagggactagagttatttttattgatttttccttatataatgctaatgtaaatctattttgtattatcagattggtggcagaattccctgcaactggaggaatacttacttcatggcagttttactctgtgaagctcctcagatatgttagctactatgactattttattgcttcctgtgaaatcacattctgtatttttctttttgtcttcacaacacaagaagtcaaaaaaataaaagaatttaagtctgcctatttcaaaa

SEQ ID NO: 167289 - DNA, 2333 bp, Homo sapiens
  Payload ID: 12918
  Gene Symbol: PKD2L2
  Gene Name: polycystic kidney disease 2-like 2
  Uniprot ID: Q9NZM6
  ENST ID: ENST00000508638
  CDS Start-End: 56-1627
cgcgcaagcgccgcggcctcaggcgaacgaacgggcggtgtagtgcaggtccgccatggctgaggcgtcacggtggcaccgaggcggggcttcgaaacataagttgcattacagaaaggaagtagaaattacaaccacacttcaggaattgttactctactttatttttttaataaacctatgtatattgacttttgggatggtaaacccacatatgtattacttaaacaaggttatgtcatctctatttttggacacttctgtgcctggtgaagaaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatactgaatggagatattctacttctaataccaactccccttggcactggggatttcttggtgtttaccgaaatgggggatacattttcactttatcaaaatcgaaatctgaaaccaaaaacaagttcattgaccttcgactgaacagctggatcacaagagggactagagttatttttattgatttttccttatataatgctaatgtaaatctattttgtattatcagattggtggcagaattccctgcaactggaggaatacttacttcatggcagttttactctgtgaagctcctcagatatgttagctactatgactattttattgcttcctgtgaaatcacattctgtatttttctttttgtcttcacaacacaagaagtcaaaaaaataaaagaatttaagtctgcctatttcaaaagtatttggaactggctagaattgctacttttgctgttgtgttttgtggctgtttccttcaacacatactataatgtacaaatttttctcttacttggacagctgttgaaaagtactgaaaaatattcagatttctattttcttgcatgctggcacatttattacaataatataattgctattaccatcttttttgcatggataaagaatatgttcttggcaattattaatgatacctattctgaagtgaaagctgactattcaataggcagaaggctagattttgaacttggcaaaatgattaaacagagttacaaaaatgttctcgagaaattcagactgaagaaagctcaaaaagatgaagacaagaaaaccaaaggcagcggagatttggctgaacaagccagaagagaaggctttgacgaaaatgagattcaaaacgcagagcagatgaaaaaatggaaagagaggcttgagaaaaagtattattctatggaaattcaagatgactaccagcctgtcactcaagaagaatttcgagaactttttttatatgctgtggagctggagaaggaattacactacatcaatttgaagctaaatcaagtggtgagaaaggtttcagctctatagtattgagacaagtggagtcattctgtaagaaaaaggcaacagaagaattcagtatgaagattttcctccaattttcttcagtaatgagaaacaaaaagttggtaataacaaaaagcttgcatttccaaagttcttgaagttgaaaggataaaattccagtcttttgctaaaaggatgtatctgtagtacaaaacaatgaagtaaaccatatgtttgctaaaggtggagaggacagtctgtggttaatatggaacatcacttacgctcccttgagagggcctacttactctcccatcatttgttttgtttagtggcaccacaaccaagtacaaaatgagattctctgagtgcctgacaaaacgaatttaagtaccagccaagtacacacgatgatagcttcaaggaatacaactgactttatgatatgaattttcaaggaacgtatcttatatggattttgaagaatcttgtttgcttataagaacttcaagaagcctaagcttggctttaattttcttgtactctctgtactcctcaagcactggaacacgatcctctttctgggcattcctaggggagaaaataaaatttgtaatgttctagagatcatttggaaaaaaagatccaaaagttgtcttaatatgagacatactgttactaaacataagttcaaataaaaagttgttctgttaaaaaaaaaaaaaaa

SEQ ID NO: 167290 - DNA, 830 bp, Homo sapiens
  Payload ID: 12918
  Gene Symbol: PKD2L2
  Gene Name: polycystic kidney disease 2-like 2
  ENST ID: ENST00000511176
  CDS Start-End: 579-830
agactggcgagaagacatcatgatataaaatctgttagtggccgggcgcagtggctcaagcctgtaatcccaacactttgggaggccgaggcgggcggatcacaaggtcaagagatcgagaccatcctggccaacatggtgaaaccccatctctactaaaaatacgaaaattagctgggtgtggtggcgcgcgcctgtagtcccagctactcgggaggctgaggcaggagaatcgcttgaaccggggaggcggaggctgcagtgagacgagatcgcgtcactgaactccagcctggcgacagagctagactccgtctcaaaaaaaaaatctgttattaatagtatatagtaaaaaaattatccctgcctcgtaaaactaagaattgaaaaatagccagaagctattggagctttcctccccgcagtgggcttcgaaacataagttgcattacagaaaggaagtagaaattacaaccacacttcaggaattgttactctactttatttttttaataaacctatgtatataaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatact

SEQ ID NO: 167291 - DNA, 2282 bp, Homo sapiens
  Payload ID: 12918
  Gene Symbol: PKD2L2
  Gene Name: polycystic kidney disease 2-like 2
  Uniprot ID: Q9NZM6
  ENST ID: ENST00000508883
  CDS Start-End: 27-1901
aacgggcggtgtagtgcaggtccgccatggctgaggcgtcacggtggcaccgaggcggggcttcgaaacataagttgcattacagaaaggaagtagaaattacaaccacacttcaggaattgttactctactttatttttttaataaacctatgtatattgacttttgggatggtaaacccacatatgtattacttaaacaaggttatgtcatctctatttttggacacttctgtgcctggtgaagaaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatactgaatggagatattctacttctaataccaactccccttggcactggggatttcttggtgtttaccgaaatgggggatacattttcactttatcaaaatcgaaatctgaaaccaaaaacaagttcattgaccttcgactgaacagctggatcacaagagggactagagttatttttattgatttttccttatataatgctaatgtaaatctattttgtattatcagattggtggcagaattccctgcaactggaggaatacttacttcatggcagttttactctgtgaagctcctcagatatgttagctactatgactattttattgcttcctgtgaaatcacattctgtatttttctttttgtcttcacaacacaagaagtcaaaaaaataaaagaatttaagtctgcctatttcaaaagtatttggaactggctagaattgctacttttgctgttgtgttttgtggctgtttccttcaacacatactataatgtacaaatttttctcttacttggacagctgttgaaaagtactgaaaaatattcagatttctattttcttgcatgctggcacatttattacaataatataattgctattaccatcttttttgcatggataaagatattcaaattcataagctttaacaagacaatgtctcagctgtcatcaaccttgtcccgttgtgttaaagacatagtaggatttgccatcatgttttttataatattctttgcttatgcccagttaggatttcttgtttttggatcacaagttgatgacttttccacttttcagaattccatatttgcacaatttcgaattgttcttggagattttaattttgctggtattcagcaagccaatcctatcttgggacccatttacttcatcactttcatcttttttgtgttctttgtcctgctgaatatgttcttggcaattattaatgatacctattctgaagtgaaagctgactattcaataggcagaaggctagattttgaacttggcaaaatgattaaacagagttacaaaaatgttctcgagaaattcagactgaagaaagctcaaaaagatgaagacaagaaaaccaaaggcagcggagatttggctgaacaagccagaagagaaggctttgacgaaaatgagattcaaaacgcagagcagatgaaaaaatggaaagagaggcttgagaaaaagtattattctatggaaattcaagatgactaccagcctgtcactcaagaagaatttcgagaactttttttatatgctgtggagctggagaaggaattacactacatcaatttgaagctaaatcaagtggtgagaaaggtttcagctctatagtattgagacaagtggagagacagagtctcactctgtcgcccaggctggaacagcggtgcgacagtggcctcaacatcctccaaacagagaatcaagtgatcctcttgcctcagcctcccaagtatctgggactacacgcgaacaccaccacccctggctaatttaaacaaaatttttatacagtctgggtcccactatattgcccaggctggtcttgaactcctggcctcaagggatcctcctgcctcagcttcaaaaactgctgggattataggcatgagccactgtgcctggctagatttttttttaatttttgaaatacagtaatgttttatttaaaaatgggaatgacaataaatatttgcaaatcacacttgaaaa

SEQ ID NO: 167292 - DNA, 1927 bp, Homo sapiens
  Payload ID: 12918
  Gene Symbol: PKD2L2
  Gene Name: polycystic kidney disease 2-like 2
  ENST ID: ENST00000503015
  CDS Start-End: 1380-1927
acagctcagccaattcctctagaaactaagctagacttgccatggtttgcacttcaaaggcaatcacaagaacttaaatcatgactgaatctactgaatttgtgattttgttttaaccaaacaggtttctaattcttcaggatttttcagtctgttatgctcaaaggaataagaatagtctctagagattacctgcttaattctcatagttaatgtaaatttgacagcccggtagtcccagctgctgggagaggttgagctggggatcccttaagatcaggagtttgaggccagactgggaaatatagcgagactccatctctaaaaaaaaaaaaattatgtaaatttgattacctatatatgggtgtttttcctctaataatttcaatttcagataatctgttactttagaaagcataattttgtgaacagctgagagtcccagtacaggaaagcccaaatccttttgttaaaactattctaaagctttttttcctctcgggcttctagttcactggctgtcagccttttgcgaggcctctcctgttcctctcatcgatggtagtttttgaccctcactactgtgtggccgttttgctttttatctacacataaaacagcatttatcgacagcagtctacatctctttcagggaaataacaaaagtggctttatcttttactttcaaaactggttagtggttttctttgcaggtttccctggggcctttggactggattccattttattttcctttttatcaacacgagaatccgtcctggtcttacatcctggagggcttttggctgccttaatttacagccaaattagtttggccttttctatagctggtttaccaaccttctcatctttgcaaagcttctgggtcagatgtgggtctgggccccaggactcctgtgtcggcctgacctttcacataatcactgcagagtttttcatctatttttacatcacgggggcaggggagtggaagctacttccagcaacagctctcggttaataaccagtttctgcaagtagcagcagcagcagcagcgtagggtcacggttaggaatttgggcttgggcatccaagacttggccccaacttccagtgaattacttcatttctcagcttctcggtttcttcaggcctaaaatgaggacaaaaatacctacctttcacggaggtggatgtggagactaacaaggcgataaatgttaaaggggcttcgaaacataagttgcattacagaaaggaagtagaaattacaaccacacttcaggaattgttactctactttatttttttaataaacctatgtatataaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatactgaatggagatattctacttctaataccaactccccttggcactggggatttcttggtgtttaccgaaatgggggatacattttcactttatcaaaatcgaaatctgaaaccaaaaacaagttcattgaccttcgactgaacagctggatcacaagagggactagagttatttttattgatttttccttatataatgctaatgtaaatctattttgtattatcagattggtggcagaattccctgcaactggaggaatacttacttcatggcagttttactctgtgaagctcctcag

SEQ ID NO: 167293 - DNA, 2185 bp, Homo sapiens
  Payload ID: 12918
  Gene Symbol: PKD2L2
  Gene Name: polycystic kidney disease 2-like 2
  Uniprot ID: Q9NZM6
  ENST ID: ENST00000502810
  CDS Start-End: 32-1840
gaacgaacgggcggtgtagtgcaggtccgccatggctgaggcgtcacggtggcaccgaggcggggcttcgaaacataagttgcattacagaaaggaagtagaaattacaaccacacttcaggaattgttactctactttatttttttaataaacctatgtatattgacttttgggatggtaaacccacatatgtattacttaaacaaggttatgtcatctctatttttggacacttctgtgcctggtgaagaaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatactgaatggagatattctacttctaataccaactccccttggcactggggatttcttggtgtttaccgaaatgggggatacattttcactttatcaaaatcgaaatctgaaaccaaaaacaagttcattgaccttcgactgaacagctggatcacaagagggactagagttatttttattgatttttccttatataatgctaatgtaaatctattttgtattatcagattggtggcagaattccctgcaactggaggaatacttacttcatggcagttttactctgtgaagctcctcagatatgttagctactatgactattttattgcttcctgtgaaatcacattctgtatttttctttttgtcttcacaacacaagaagtcaaaaaaataaaagaatttaagtctgcctatttcaaaagtatttggaactggctagaattgctacttttgctgctgttgaaaagtactgaaaaatattcagatttctattttcttgcatgctggcacatttattacaataatataattgctattaccatcttttttgcatggataaagatattcaaattcataagctttaacaagacaatgtctcagctgtcatcaaccttgtcccgttgtgttaaagacatagtaggatttgccatcatgttttttataatattctttgcttatgcccagttaggatttcttgtttttggatcacaagttgatgacttttccacttttcagaattccatatttgcacaatttcgaattgttcttggagattttaattttgctggtattcagcaagccaatcctatcttgggacccatttacttcatcactttcatcttttttgtgttctttgtcctgctgaatatgttcttggcaattattaatgatacctattctgaagtgaaagctgactattcaataggcagaaggctagattttgaacttggcaaaatgattaaacagagttacaaaaatgttctcgagaaattcagactgaagaaagctcaaaaagatgaagacaagaaaaccaaaggcagcggagatttggctgaacaagccagaagagaaggctttgacgaaaatgagattcaaaacgcagagcagatgaaaaaatggaaagagaggcttgagaaaaagtattattctatggaaattcaagatgactaccagcctgtcactcaagaagaatttcgagaactttttttatatgctgtggagctggagaaggaattacactacatcaatttgaagctaaatcaagtggtgagaaaggtttcagctctatagtattgagacaagtggagtggcaccacaaccaagtacaaaatgagattctctgagtgcctgacaaaacgaatttaagtaccagccaagtacacacgatgatagcttcaaggaatacaactgactttatgatatgaattttcaaggaacgtatcttatatggattttgaagaatcttgtttgcttataagaacttcaagaagcctaagcttggctttaattttcttgtactctctgtactcctcaagcactggaacacgatcctctttctgggcattcctaggggagaaaataaaatttgtaatgttctagagatcatttggaaaaaaagatccaaaagttgtctta

SEQ ID NO: 167294 - DNA, 7693 bp, Homo sapiens
  Payload ID: 12919
  Gene Symbol: PKDREJ
  Gene Name: polycystin (PKD) family receptor for egg jelly
  Uniprot ID: Q9NTG1
  ENST ID: ENST00000253255
  CDS Start-End: 34-6795
gcggcctctcccagcttctcctgggccggcgccatgaggcctgggcccgctctcctccttctgggcgtgggcctgagcctgagcgtcggccgcctcccgctgccgccggttcctcgcggggcacaagccgccgtctccggggcgcccggtggcctcctcaggggcgccccgggcctcggggtgcgcggcggccgcgccctcctcagtctgcggcccagcgcggtgcgggcgggcggcgctgtcctgagcggccgcggcagcctctgcttcccccatggcgggaccgggcggcgctggtactgcctcgacttgcgcgtcctgctcagcgcccaacgcctgccctggccggccgcgcccgcgctcgcgctcgtcgacctgcagctctccgcgcgcggcggccgcctctccctgacgtggtccgtgcggctgccgcgctcgcccgggcgcctggcctgggccttccgcctgcggctgctcggacccggcgccgcccgcccggcctcccccgcggcccgcgtctccccgcgctccgccgcgccaggcccgcggccccagcagggcttcgtggcccgcaccgagtgccccacagacggccccgcgcgcgtgatgttgcaggccgtcaactcgtccagccacagagccgtcgagtcgtccgtgtcctgtcagataaacgcctgcgtcatccagcgcgtgaggatcaacacggaccagaagggcgcccccgtgcgcctgagcatgcaggcggaggccaccatcaacgcctcggtgcagctggactgcccggccgcgcgcgccatcgcccagtactggcaggtgttctccgtgcccgccgtgggtcaggcgcccgactggacgcagcccttggatctgccccagctcgagatcaggaacagccccttgttcattcacatccccaataattcgttacagtggggagtgtatgtgtttaatttcacggtgtccatcaccacagggaaccccaagatgcccgaggtgaaagactcggacgccgtctatgtctggatcgtcaggagttccctgcaggcggtgatgcttggcgatgccaacataacagctaatttcacagagcagctgattctggacgggtccacgtcctcggacccagatgcggacagcccgttacagggactccagttcttttggtactgtaccacagatcccagaaactacggtggggatcgaataatcctggggagcaaggaagtctgtcaccccgagcaggccaatctgaaatggccctgggcctcgggccctgtactgacacttttgccagaaacacttaaaggcgaccacgtgtatttcttcagaatggtgattcggaaggactctaggacagcgttttctgataagagggtccacgtgctccaaggaccaaaagccatagcacacatcacatgtatcgaaaattgtgagagaaacttcattgtctctgatagattttctttgttcctaaattgcacaaattgtgcaagccgtgatttctataaatggtcaattttgtcttcttcaggtggtgagatgctatttgattggatgggggaaactgtaacaggaaggaatggtgcttatctgtctataaaagcttttgcttttcggcattttttggaagctgagttttcgatttctctgtatctagcatgttggagtggagtgacctcggtcttcaggcattcttttattattaaccatggccctcagatcggagaatgcaaaattaatccagctaaaggaattgcacttattactaaatttgttgtccagtgtagtaattttagggataagcacgtccctcttacatataaaataattgtttctgatttgcacagtgttggtgaaatcagttcagtaaaagagaacaccctggggaccatcctgtacttggggcctcagtccacagtacccccttcctttctccctgttggtatgttggctagtcaatatggcttgaagatatatgcccaggtctatgattctctaggagctttttctcaggtgactttgcatgccaccgcacaggctcccactgacaaaaattcatcaaagacagtgttgaatcagttactcagtttcaccgtgggaccaagttcattgctgtctactttgattcaaaagaaggattttttacctgcaggttacttactgtatatagtagcttccgttttgaataacatgaaaactgaattacctctccgagatgacagagtcaatctccgaaaacacctcatcgatcagtctttccttcttcctgtaagcactttggtagaaattggccaggtagtcatgactattaccaaattaacccagaaaccctctgaattcacttgggatgctcagaaacgtgccaccatgagggtatggcaagcaaatcaagccctacaagagtatcagcaaaaagataaacgctttcgatctgaacaaatagaaatcgtgagtactggaatactaatgagtttgtctaatattcttaaaatgacttctcctcaccaagtagttaaagatcctttctatgtaatagaatctctatcagacacaatactggctaataaagtgccagggaacaaaaccacctcaatgagaacccccaatttcaacatgtatgtcaagaaagttgaaaagtggggtatcaaccagctcttcagaaatgagaaacactgcagaaattgtttttatccaacactcaatgtgagcagtgttcctggtctgtctgcaaatggtcccatttctacaatgttttgtgatttcacaaatgacctctttccttggttaaatgatcaggaaaacacttcggtggaggtgtctggattcagaatgacaggagttgcagataacggtagtgtgctagagatcacacctgatgtagcggaagtgtaccttgtcaggaaaaacttgacctttgcagcttttaatctcacagtgggacccaacagcgaggttgatgggtccttgaagaagacgacaggtgggtttagctttcaagtggacagcacagtgcttagggaggttctggtccacatagtaacagaagtgatggtgctgttcacagtgttggtgtacacaggcagtcagatcactcccacagcgctggtcgccaccttcctggtgcctcatgacatccctccatttgccagccagagtgccctgtttgacccagcctgcacagtgaagaaggcccgtgtagtctgcctccctgtgtccctgctgcaactcatagctcagcacagccactctccccactgtactgtatccatagttctgcaggcacctcgttttgtcatgaagctcaatgacaagctagtgagaatttctattttcagcgtccagtgcttggacatgtatgggatccagagtgaatggagagagggttattgcattcttggtgagaagaccagctggtatgaggtgcactgcatctgcaagaatgtagtaagggctaggcggcagctgggcacaatcggactcacgggcattcacctgcatacccactatgtgatggccaaggtgattgtgatccctaatcctgtggatctacggttaaacatcatcaagagccttcaccaaaaccccgtgaccctcttcactgtgcttttcattattctcttatacgtgggcctagctttttgggctttatacagggatgaaatggaccagcatcttcgggggcatgtgatagttctaccagataatgatccttatgataatttatgctacttggtgactatttttacaggaagtcgttgggggtctgggaccagggccaatgtctttgtgcaacttagaggaactgtgagtaccagcgacgtgcattgtttaagccatccacatttcacaactctctaccgaggtagcatcaacactttcctcctaacgacaaaaagtgacttgggggacatccattccatccgtgtgtggcacaacaacgagggtcgatcgcctagctggtatttaagtagaatcaaagtggaaaatctgtttagcaggcacatttggctgttcatatgccagaaatggctttctgttgataccactttggacagaacatttcacgttacccatccagatgagcgtctgactagaaaagactttttctttatagatgtgagtagtaatctccggaaaaaccacatgtggttctctatttttgctagtgttgttgctaaaacattcaataggctccagagattgtcctgttgtttagcaatgttgcttagctctcttctttgtaacattatgttctttaatctaaatagacaagaacaaactgagtcaagagagaggaaatacatgagatcaatgatgataggaattgaaagtgtcttaattacaatccctgtgcaattattaataacttttttgttcacctgttcccagaggaaacctcaagcggatctaaaggaggtatctcctcaaaagcatcctctaatgtcagaagcaagtgagcactgggaagaatacttgagaaagtggcatgcttacgaaactgctaaggtgcaccccagggaggttgcaaaacctgcatctaaaggaaagcccaggcttccaaaggcttctcctaaggcaacctccaaacccaagcacaggcataggaaagcacaaatcaagaccccggagaccctcgggccaaatacaaattccaataacaacatagaagatgatcaggatgtccattccgaacagcacccttcccaaaaggatctccagcagcttaagaaaaagccccggatcgtcctaccttggtggtgtgtttatgttgcatggtttttggtttttgctacttctagcatatcctcattcttcattgtattttatggactgacttacggctatgacaagtcaatagaatggctctttgcatctttttgttcattctgtcagtcagttcttctggtgcagccatctaaaattatactcctgtcaggcttcagaacgaataaacccaagtattgcaaaaacctttcatggtcaaccaagtataaatatactgagatcaggttggatggaatgcgtatgcatccagaagaaatgcagaggatacatgaccagatcgtccgaatccgaggcacgaggatgtaccaaccccttacagaagatgaaatcagaatattcaaaagaaagaagaggatcaagagaagagcactcctgtttctgagttacattctaactcactttatctttctagcccttctgttgatccttatcgtcttactacgtcacactgactgcttttactataaccagtttattcgtgatcggttctctatggatcttgctactgtgactaagctggaagacatctatagatggctaaacagcgtgctgttgcctttgttacacaatgacctgaatccaacatttcttcctgaaagctcgtctaaaatccttggccttccattgatgaggcaagtgagagcaaaatctagtgaaaaaatgtgtctacctgccgaaaagtttgtgcaaaacagcatcagaagagaaattcattgtcaccccaaatatggcattgacccagaagacacaaaaaactattctggcttttggaatgaagttgataagcaggctatagatgagagtaccaatggatttacttataagcctcaaggaacgcaatggctatattattcctatggactactacacacctatggatctggaggatatgcactctatttttttccagaacagcagcggtttaattccacactgaggctcaaagaacttcaagaaagcaattggctggatgagaagacatgggctgtggttttggaattaacaacttttaatccagatataaatctgttctgtagcatttcggtcatatttgaagtctctcagttaggagttgtcaacacaagcatatctctgcactctttttcacttgctgattttgacagaaaagcttcagcagaaatctacttgtatgtggccattctcatttttttcttagcctacgttgttgatgagggttgtatcattatgcaagaaagagcctcctatgtgagaagtgtgtataatttgctcaactttgctttaaagtgcatatttactgtgttgattgtgctctttctcaggaaacatttcctggccactggcataattcggttttacttgtcgaacccagaagacttcattccctttcatgcagtttctcaggtagatcacattatgaggataattttgggtttcctgttatttctgacaattttgaagaccctcaggtattccagattcttctacgatgtgcgcctggctcagagggccatccaggctgccctccctggcatctgccacatggcatttgttgtgtccgtgtatttcttcgtatacatggcttttggttacctggtgtttggtcagcatgaatggaactacagtaacttgattcattccactcagacagtattttcctattgtgtctcagctttccagaacactgaattttccaataacaggattctgggggtcctgttcctctcatctttcatgctggtgatgatctgcgtcttgatcaacttatttcaggctgtaattctgtctgcatatgaggaaatgaagcagcccgtgtatgaggagccatcggatgaagtggaagcaatgacctatttgtgccgtaagctgagaaccatgttcagctttctgacctcgcaatctaaggccaaagatgagcctgagttctttattgacatgctgtatgggcagccagagaagaacagccaccgttatctggggctgaagaccagaaacatcaacgggaagaaaatggtttaccttgttgtttgatgaatgatggtttcatgagtcacaagcaagcgttcccccaactgctgagtctgtgggattaaggggattagggagtgtcagtggcctagtcatgctttctactcatgtccttcacaaggcacatcccctacatttggaagaatccccaatcttgtcctctgctcttgggagtgtaaaagttgggagtgtagtgtagcatctggggagacagcaggatcacagtgtgggattcctggactgatttccctttagaggggagttatgtgactccccgtacaagggcaaccctgtttctttggtgcctgcagtttagagaaggcagagccactggttttgagaaccagatttgagagagggacctggccagggtggagcattgtctgggtgtttctgcgcttgacccatgctggaagctaatggcctgttgctcctgacagagccccaaactcctcggcctcactgggaggcccctttgtagaccagggctcccctcctcttgttccccctgggcttagggcctcgtggggagttccaggacttgcttcatgcttgagaatgcagatgtggtgcttctcatttattcttaaagctactggtagttaaagtaaaattcagtaacattttctgaccaagagacatgttttgttaaacaacaaaaaggtacatatgggttcacattgaaatatgtctatatgctgaatatagcaacatatgcatctaagatttgggcatttggttattaatagcgtgctggactattcaggaataaggaaaatgtggtttatcacttaagagaaacaagggctggtagctgtactattttcactcagaagcatgttcatttatgtagatgccactttaagctttatcagaattaaatgtgagatttcttctttga

SEQ ID NO: 167295 - DNA, 1113 bp, Homo sapiens
  Payload ID: 12920
  Gene Symbol: PQBP1
  Gene Name: polyglutamine binding protein 1
  Uniprot ID: O60828
  ENST ID: ENST00000218224
  CDS Start-End: 258-1055
gggagaggaacagggccctggagcacctggtttcggggacagtagggttggtgggagttgcgatgatattgccacctacctcttacatcttttagtgcgtatgttctgtccacccagctactggttcatttgagtagatcggagtcagatgagtacatgtttacgggaggcgcttggttacgggatccagataggaatctttatctgagctgcttgtcagtttgttcgtctgtccctaggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacc

SEQ ID NO: 167296 - DNA, 664 bp, Homo sapiens
  Payload ID: 12920
  Gene Symbol: PQBP1
  Gene Name: polyglutamine binding protein 1
  Uniprot ID: O60828
  ENST ID: ENST00000247140
  CDS Start-End: 94-606
caggctcggggagtgaaggcctcgttgagagaaggtctcattcggtgttttgggaagagagtcgtgtgggcccaggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacc

SEQ ID NO: 167297 - DNA, 1056 bp, Homo sapiens
  Payload ID: 12920
  Gene Symbol: PQBP1
  Gene Name: polyglutamine binding protein 1
  Uniprot ID: O60828
  ENST ID: ENST00000376563
  CDS Start-End: 201-998
tgcctcctgagcgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtaacgttggggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacc

SEQ ID NO: 167298 - DNA, 760 bp, Homo sapiens
  Payload ID: 12920
  Gene Symbol: PQBP1
  Gene Name: polyglutamine binding protein 1
  Uniprot ID: O60828
  ENST ID: ENST00000376566
  CDS Start-End: 190-702
tgcctcctgagcgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacc

SEQ ID NO: 167299 - DNA, 965 bp, Homo sapiens
  Payload ID: 12920
  Gene Symbol: PQBP1
  Gene Name: polyglutamine binding protein 1
  Uniprot ID: O60828
  ENST ID: ENST00000396763
  CDS Start-End: 110-907
agaggaacagggccctggagcacctggtttcggggacagtagggttggtgggagttgcgatgatattgccacctacctcttacatcttttagtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacc

SEQ ID NO: 167300 - DNA, 1020 bp, Homo sapiens
  Payload ID: 12920
  Gene Symbol: PQBP1
  Gene Name: polyglutamine binding protein 1
  Uniprot ID: O60828
  ENST ID: ENST00000447146
  CDS Start-End: 171-968
agttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctg

SEQ ID NO: 167301 - DNA, 451 bp, Homo sapiens
  Payload ID: 12920
  Gene Symbol: PQBP1
  Gene Name: polyglutamine binding protein 1
  ENST ID: ENST00000456306
  CDS Start-End: 1-451
atattgccacctacctcttacatcttttagtgcaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcaga

SEQ ID NO: 167302 - DNA, 744 bp, Homo sapiens
  Payload ID: 12920
  Gene Symbol: PQBP1
  Gene Name: polyglutamine binding protein 1
  ENST ID: ENST00000443648
  CDS Start-End: 106-744
gaacagggccctggagcacctggtttcggggacagtagggttggtgggagttgcgatgatattgccacctacctcttacatcttttagtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccc

SEQ ID NO: 167303 - DNA, 5033 bp, Homo sapiens
  Payload ID: 12921
  Gene Symbol: PHC1
  Gene Name: polyhomeotic homolog 1 (Drosophila)
  ENST ID: ENST00000433083
  CDS Start-End: 146-3025
ggccgagcgagcccccagcccagcctggcgactggggaccccggcacatgaggtggacgcccccggggaagacttgggtgcacagccaggcgagaaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacgggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccagaaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccgggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaagtatttgactggggcacatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtacaaaaggtgatggttttttttcttcattttaaaacaccagggtgtgggggagggatgcaaacaaataacaaaaaagatgcttttgtaacattattttccctgtttagaaagaaaaaaatcactccaatagtattgaaaagtccaaagatgaaatagtttcattttcttttcctaaggcttataaaaggccccctgcctgttgattccatccctcttttgtgtccagtggagccatgttactcttcagtggcccaggggttcactattaaagaaagatcagtccaggtttctgggcacatggcctaaacaggaagatggaagcatcagaggattaaaaacctttccccacagaaatgtgggcaagaagacacttccctgagccagcagaagggacaggtgcagcagcattccacacccagcgcagaggacagcagagccctcgatgtcccacttctgcttccgttccctttctagaagattgaaaaaaaggtcaaaaccacatgcctgtggagaaagtgcgacatgtttagaaatactggtagggaaccaggagtaagaaaagctttaccagcttttactacaaatggatgaaagacatcaggatcccaccaccgcaaggtaaagtgacttcccttttctggaacccctgtggcacaggagtaccaattttcctttccaacgaactggatttctggataggcattttggctgtatgtggacagataagaccacagtccttagcccaatcccagctatacagtcaccccaatttccacaaatgatgtgatggtaccgtataatcctgtaattgggaaatttcacatttttcctgtcctaatctcagaggtgggagaagcaagtctagaacatctccaggctcagactaaacgagagtacttggactgcaaccaagtaatcactgcaaagtagttccaagcagcaagaaataccagattctcatggaggctactatagggtacagaataacaacatgaaagcaatcaaccctgtataaataatgtttcttggcattttttttttaattaaagaaatccagtgtctcaaaaa

SEQ ID NO: 167304 - DNA, 642 bp, Homo sapiens
  Payload ID: 12921
  Gene Symbol: PHC1
  Gene Name: polyhomeotic homolog 1 (Drosophila)
  ENST ID: ENST00000539063
  CDS Start-End: 95-642
ggtggacgcccccggggaagacttgggtgcacagccaggcgagaaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctc

SEQ ID NO: 167305 - DNA, 641 bp, Homo sapiens
  Payload ID: 12921
  Gene Symbol: PHC1
  Gene Name: polyhomeotic homolog 1 (Drosophila)
  ENST ID: ENST00000544539
  CDS Start-End: 104-641
ggcacatgaggtggacgcccccggggaagacttgggtgcacagccaggcgagaaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggctgggaaacctattgcaggtaaaccgaaccctgggtcggaatgtgcctctagcctcccaactcatcctgatgcctaatgggg

SEQ ID NO: 167306 - DNA, 618 bp, Homo sapiens
  Payload ID: 12921
  Gene Symbol: PHC1
  Gene Name: polyhomeotic homolog 1 (Drosophila)
  ENST ID: ENST00000538657
  CDS Start-End: 104-618
ctcctaatgggttagctgtttctgcagcattctttcccgccttcttggagttgaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaaccctgggtcggaatgtgcctctagc

SEQ ID NO: 167307 - DNA, 3626 bp, Homo sapiens
  Payload ID: 12921
  Gene Symbol: PHC1
  Gene Name: polyhomeotic homolog 1 (Drosophila)
  Uniprot ID: P78364
  ENST ID: ENST00000544916
  CDS Start-End: 136-3150
gcccccagcccagcctggcgactggggaccccggcacatgaggtggacgcccccggggaagacttgggtgcacagccaggcgagaaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccagaaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccgggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgta

SEQ ID NO: 167308 - DNA, 4292 bp, Homo sapiens
  Payload ID: 12921
  Gene Symbol: PHC1
  Gene Name: polyhomeotic homolog 1 (Drosophila)
  Uniprot ID: P78364
  ENST ID: ENST00000543824
  CDS Start-End: 333-3347
cgggcaggaagtgacaggcccggagcgagccccggaggcctggctgagccgcggccgggcccgcacccggagcggcgggaggggcggggagccgcggtcgcgccgggcgcctcccaccccgccctcggcgcccccgcccctccaggaaggggaggaggcgaggggagcccgccgcggaggccgagcgagcccccagcccagcctggcgactggggaccccggcacatgaggtggacgcccccggggaagacttgggtgcacagccaggcgagaaggattcatgggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccagaaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccgggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaagtatttgactggggcacatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtacaaaa

SEQ ID NO: 167309 - DNA, 561 bp, Homo sapiens
  Payload ID: 12921
  Gene Symbol: PHC1
  Gene Name: polyhomeotic homolog 1 (Drosophila)
  ENST ID: ENST00000537610
  CDS Start-End: 1-561
ttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccgggtaaaccccagacattggctgtcaaacgcaaggctgactctgaggaggagagagatgatgtctccacattgggttcaatgcttcctgccaaggcatctccagtagcagaaagcccaaaagtcatggacgagaaga

SEQ ID NO: 167310 - DNA, 3869 bp, Homo sapiens
  Payload ID: 12921
  Gene Symbol: PHC1
  Gene Name: polyhomeotic homolog 1 (Drosophila)
  ENST ID: ENST00000540574
  CDS Start-End: 359-913
caggaatcctggttttggtggcagtttcccttgattttattgagacttttaagttggtccctttacatttttatttctagttcacaatccaaaaaaaattattaatcagaattcaggtttgggaagacgaggggtcatacggtttgtattttcacatgtgaatgtaggaattatgttctctatacctagcaaaggggtctcgtgtctctgagtccagtgaactaaatccagtaatctataaaactgtgccgtgctgcctctaatccttacccactttttttcttcacatgctgataatgaggattcatgggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccagaaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcagggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcataggcagtctagagaactaggactgctcagccttatcctggagtggagcatttagcccaggtcttaattctccaagaggaggaatacatagtatggcttataaaaggccccctgcctgttgattccatccctcttttgtgtccagtggagccatgttactcttcagtggcccaggggttcactattaaagaaagatcagtccaggtttctgggcacatggcctaaacaggaagatggaagcatcagaggattaaaaacctttccccacagaaatgtgggcaagaagacacttccctgagccagcagaagggacaggtgcagcagcattccacacccagcgcagaggacagcagagccctcgatgtcccacttctgcttccgttccctttctagaagattgaaaaaaaggtcaaaaccacatgcctgtggagaaagtgcgacatgtttagaaatactggtagggaaccaggagtaagaaaagctttaccagcttttactacaaatggatgaaagacatcaggatcccaccaccgcaaggtaaagtgacttcccttttctggaacccctgtggcacaggagtaccaattttcctttccaacgaactggatttctggataggcattttggctgtatgtggacagataagaccacagtccttagcccaatcccagctatacagtcaccccaatttccacaaatgatgtgatggtaccgtataatcctgtaattgggaaatttcacatttttcctgtcctaatctcagaggtgggagaagcaagtctagaacatctccaggctcagactaaacgagagtacttggactgcaaccaagtaatcactgcaaagtagttccaagcagcaagaaataccagattctcatggaggctactatagggtacagaataacaacatgaaagcaatcaaccctgtataaataatgtttcttggcattttttttttaattaaagaaatccagtgtctcaaaaa

SEQ ID NO: 167311 - DNA, 572 bp, Homo sapiens
  Payload ID: 12921
  Gene Symbol: PHC1
  Gene Name: polyhomeotic homolog 1 (Drosophila)
  ENST ID: ENST00000535510
  CDS Start-End: 1-395
ccttctatatgcagtctgtgcacttgccgggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatg

SEQ ID NO: 167312 - DNA, 497 bp, Homo sapiens
  Payload ID: 12921
  Gene Symbol: PHC1
  Gene Name: polyhomeotic homolog 1 (Drosophila)
  ENST ID: ENST00000541181
  CDS Start-End: 24-497
cttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggtgagaggtcagcagccagctggcccgagagggaggggacaggcactacaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccaccc

SEQ ID NO: 167313 - DNA, 483 bp, Homo sapiens
  Payload ID: 12921
  Gene Symbol: PHC1
  Gene Name: polyhomeotic homolog 1 (Drosophila)
  ENST ID: ENST00000542346
  CDS Start-End: 1-300
gtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaagtat

SEQ ID NO: 167314 - DNA, 3870 bp, Homo sapiens
  Payload ID: 12922
  Gene Symbol: PHC2
  Gene Name: polyhomeotic homolog 2 (Drosophila)
  Uniprot ID: Q8IXK0
  ENST ID: ENST00000257118
  CDS Start-End: 55-2631
catctgcctgcccttctgccatccgagcgccctgactgcgccacactgcaggccatggagaatgagctgccagtcccacatacatctagcagtgcctgtgccaccagcagtaccagcggggccagtagcagcagtggctgcaacaacagcagcagtggtggaagtggccgccccaccgggccccagatttctgtgtacagtggtattccagaccggcagaccgtgcaggtgatccagcaggccctgcacagacagcccagcacggccgctcagtacctgcagcagatgtacgccgcccagcagcagcacctcatgctgcagaccgcggcgctccagcagcagcacctcagcagcgcccagctccagagcctggcagccgtacagcaggcaagcctggtatccaatagacaaggaagcacttcaggcagcaatgtgtctgcgcaggccccggcccagtcatcttcgatcaacctggcagcctccccagcagcagcccagctcctcaaccgggcccagagtgtgaactctgcagcagcctcaggcatcgctcagcaggctgtgctcttgggcaacacgtcttccccagccctgactgcaagccaagcacagatgtatctgagggcacagatgctcatcttcacgcccacggccaccgtcgctactgtgcagcctgagctcggcactggctcccccgcccggccccccacccccgcccaggtacagaacttgaccctccgaacacagcagacaccagcggcagcagcctcgggccccacccccactcagcctgtcctgcccagcttggccctgaaacccacgccgggcggtagccagcctctgcctaccccagcacagagcagaaatactgctcaggcttcccctgcaggtgccaagcctggcatagctgacagtgtgatggagccacacaagaaaggagatggcaacagcagtgtgccagggagcatggaaggccgggctgggctcagccggacggttcctgctgtggctgcccaccccctcattgcaccagcctatgctcagctgcagccacaccagctcctcccacagccatcctcaaagcacctgcagccccaatttgtgatccagcagcagccacagccacaacagcagcagccgccgccccagcagtcacggcctgtgctccaagctgagccccacccccagctcgcctcagtctctccaagcgtggccctccagcccagctcagaggcccatgccatgccactaggcccggttacacccgccctgccactccagtgtcccactgccaacctgcacaagcctggcggcagtcagcagtgtcaccctcccacacctgatactgggcctcagaatggacatcccgagggcgtgccccacacccctcaacgcaggttccagcacacttcagctgtcatcttacaactgcagcctgcttcaccaccccagcagtgtgtccctgatgactggaaagaagtggcaccaggggagaaaagtgtgcctgagacgcggtctggcccatcaccacatcagcaggctattgtcactgccatgcctggtggcctgcctgtacccacgagccctaacatccagccgtccccagctcacgagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccaaagggctgagcctcctggcctgcctgcccgcccaccctgggagtcccagtggtgaggctcagagaactgctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 167315 - DNA, 2550 bp, Homo sapiens
  Payload ID: 12922
  Gene Symbol: PHC2
  Gene Name: polyhomeotic homolog 2 (Drosophila)
  Uniprot ID: Q8IXK0
  ENST ID: ENST00000373418
  CDS Start-End: 340-1311
gcggctgcagccctcgagcgcccgccgcgcgcgcgcgcgcaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccaaagggctgagcctcctggcctgcctgcccgcccaccctgggagtcccagtggtgaggctcagagaactgctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 167316 - DNA, 2799 bp, Homo sapiens
  Payload ID: 12922
  Gene Symbol: PHC2
  Gene Name: polyhomeotic homolog 2 (Drosophila)
  ENST ID: ENST00000373422
  CDS Start-End: 166-1560
tcaaagcacctgcagccccaatttgtgatccagcagcagccacagccacaacagcagcagccgccgccccagcagtcacggcctgtgctccaagctgagccccacccccagctcgcctcagtctctccaagcgtggccctccagcccagctcagaggcccatgccatgccactaggcccggttacacccgccctgccactccagtgtcccactgccaacctgcacaagcctggcggcagtcagcagtgtcaccctcccacacctgatactgggcctcagaatggacatcccgagggcgtgccccacacccctcaacgcaggttccagcacacttcagctgtcatcttacaactgcagcctgcttcaccagtgccccagcagtgtgtccctgatgactggaaagaagtggcaccaggggagaaaagtgtgcctgagacgcggtctggcccatcaccacatcagcaggctattgtcactgccatgcctggtggcctgcctgtacccacgagccctaacatccagccgtccccagctcacgagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccaaagggctgagcctcctggcctgcctgcccgcccaccctgggagtcccagtggtgaggctcagagaactgctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 167317 - DNA, 3789 bp, Homo sapiens
  Payload ID: 12922
  Gene Symbol: PHC2
  Gene Name: polyhomeotic homolog 2 (Drosophila)
  ENST ID: ENST00000431992
  CDS Start-End: 55-2547
catctgcctgcccttctgccatccgagcgccctgactgcgccacactgcaggccatggagaatgagctgccagtcccacatacatctagcagtgcctgtgccaccagcagtaccagcggggccagtagcagcagtggctgcaacaacagcagcagtggtggaagtggccgccccaccgggccccagatttctgtgtacagtggtattccagaccggcagaccgtgcaggtgatccagcaggccctgcacagacagcccagcacggccgctcagtacctgcagcagatgtacgccgcccagcagcagcacctcatgctgcagaccgcggcgctccagcagcagcacctcagcagcgcccagctccagagcctggcagccgtacagcaggcaagcctggtatccaatagacaaggaagcacttcaggcagcaatgtgtctgcgcaggccccggcccagtcatcttcgatcaacctggcagcctccccagcagcagcccagctcctcaaccgggcccagagtgtgaactctgcagcagcctcaggcatcgctcagcaggctgtgctcttgggcaacacgtcttccccagccctgactgcaagccaagcacagatgtatctgagggcacagatggtacagaacttgaccctccgaacacagcagacaccagcggcagcagcctcgggccccacccccactcagcctgtcctgcccagcttggccctgaaacccacgccgggcggtagccagcctctgcctaccccagcacagagcagaaatactgctcaggcttcccctgcaggtgccaagcctggcatagctgacagtgtgatggagccacacaagaaaggagatggcaacagcagtgtgccagggagcatggaaggccgggctgggctcagccggacggttcctgctgtggctgcccaccccctcattgcaccagcctatgctcagctgcagccacaccagctcctcccacagccatcctcaaagcacctgcagccccaatttgtgatccagcagcagccacagccacaacagcagcagccgccgccccagcagtcacggcctgtgctccaagctgagccccacccccagctcgcctcagtctctccaagcgtggccctccagcccagctcagaggcccatgccatgccactaggcccggttacacccgccctgccactccagtgtcccactgccaacctgcacaagcctggcggcagtcagcagtgtcaccctcccacacctgatactgggcctcagaatggacatcccgagggcgtgccccacacccctcaacgcaggttccagcacacttcagctgtcatcttacaactgcagcctgcttcaccagtgccccagcagtgtgtccctgatgactggaaagaagtggcaccaggggagaaaagtgtgcctgagacgcggtctggcccatcaccacatcagcaggctattgtcactgccatgcctggtggcctgcctgtacccacgagccctaacatccagccgtccccagctcacgagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccaaagggctgagcctcctggcctgcctgcccgcccaccctgggagtcccagtggtgaggctcagagaactgctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctgtct

SEQ ID NO: 167318 - DNA, 680 bp, Homo sapiens
  Payload ID: 12923
  Gene Symbol: PHC3
  Gene Name: polyhomeotic homolog 3 (Drosophila)
  ENST ID: ENST00000486042
  CDS Start-End: 1-670
gtcagaagaggaacttccagctgcagaagctttggtccagttgccatttcagactcttcctcctccacagactgttgcggtaaacctacaagtgcaaccaccagcacctgttgatccaccagtgggaatgcatttgaaccagtgtcatctgcacaaagttttttctcttaaggtttatcaggtagaagatgtgtgtgaagaagaaatgccagaagagtcagatgaatgtgtccggatggatagaaccccaccaccacccactttgtctccagcagctataacagtggggagaggagaagatttgacttctgaacatcctttgttagagcaagtggaattacctgctgtggcatcagtcagtgcttcagtaattaaatctccatcagatccctcacatgtttctgttccaccacctccattgttacttccagctgccaccacaaggagtaacagtacatctatgcacagtagcattcccagtatagagaacaaacctccacaggctattgttaaaccacagatcctaacccatgttattgaaggctttgtgattcaggagggattggagccatttcctgtaagtagcaagcatatttgtgtgtgtgtttgtaatttatataacattattttaaaagttacatattactgttctctaataaaaagcttgtaattttatttca

SEQ ID NO: 167319 - DNA, 1075 bp, Homo sapiens
  Payload ID: 12923
  Gene Symbol: PHC3
  Gene Name: polyhomeotic homolog 3 (Drosophila)
  ENST ID: ENST00000481639
  CDS Start-End: 33-476
gcgcagcccatgttagtgatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctgtaagttccctaaatttttttttcctggatttaaaattttaaagaattgttttccaaaagtaaactgttgttatttatgaagctgttattataatttgttgcatgctgtttaaagtaacaattgcccagaaatagaaatgataaaattcaagaattcagaactaatgttaaacttatgaaaatctgagtcttaaaaaaatctttttgtattatttcttgtatatccatttgcactgatcatgttcagatcttatgtggtttcagctttctgtgtgtattgaaagcctaaaatatacaatgcagggatattggccatgaatttactgtgatatacaatagtatgtcatgtccttggtagacatctaagcatttctaactttgtgcaattcacattttagaaattatactttcagcttacatgagttatttgggttcaatttgcaagtatccattcaagatagggtaatttattttgagaaaggagtaaaagaaagctgattcgctatattgcacatatatattgggaaattgtgccaagtttcccaggtaaaataaatttatgggcatggtaatacttgtttagcttttaattttggtataattttaaactgcaataataataaaaaaatttctgtatctac

SEQ ID NO: 167320 - DNA, 987 bp, Homo sapiens
  Payload ID: 12923
  Gene Symbol: PHC3
  Gene Name: polyhomeotic homolog 3 (Drosophila)
  ENST ID: ENST00000479467
  CDS Start-End: 33-632
gcgcagcccatgttagtgatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaaatcaacctctccacttctcctacacctgcacagttaataagccgttcccaggcttccagttctaccagcggcagtattacccaacagactatgttactagggagtacttcccctaccctaacggcaagccaagctcaaatgtatctccgagctcaaatgctgattttcacacccgctaccactgtggctgctgtacagtctgacattcctgttgtctcgtcgtcatcgtcatcttcctgtcagtctgcagctactcaggttcagaatttaacattacgcagccagaagttgggtgtattatctagctcacagaatggtccaccaaaaagcactagtcaaactcagtcattgacaatttgtcataacaaaacaacagtgaccagttctaaaatcagccaacgagatccttctccagaaagtaataagaaaggagagagcccaagcctggaatcacgaagcacagctgtcacccggacatcaagtattcaccagttaatagcaccaggtgggataaaacttttgttgaaaatagttgtattattcattttcttagcagac

SEQ ID NO: 167321 - DNA, 580 bp, Homo sapiens
  Payload ID: 12923
  Gene Symbol: PHC3
  Gene Name: polyhomeotic homolog 3 (Drosophila)
  ENST ID: ENST00000466189
  CDS Start-End: 35-580
atgcgcagcccatgttagtgatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctgttcagaatttaacattacgcagccagaagttgggtgtattatctagctcacagaatggtccaccaaaaagcactagtcaaactcagtcattgacaatttgtcataacaaaacaacagtgaccagttctaaa

SEQ ID NO: 167322 - DNA, 657 bp, Homo sapiens
  Payload ID: 12923
  Gene Symbol: PHC3
  Gene Name: polyhomeotic homolog 3 (Drosophila)
  ENST ID: ENST00000484931
  CDS Start-End: 16-657
gatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaacttcatattctccaattcagcctcattctctaataaaacatcagcagattcctcttcattcaccaccttccaaagtttcccatcatcagctgatattacaacagcagcaacagcaaattcagccaatcacacttcagaattcaactcaagacccacccccatcccagcactgtataccactccagaaccatggccttcctccagctcccagtaatgcccagtcacagcattgttcaccgattcag

SEQ ID NO: 167323 - DNA, 913 bp, Homo sapiens
  Payload ID: 12923
  Gene Symbol: PHC3
  Gene Name: polyhomeotic homolog 3 (Drosophila)
  ENST ID: ENST00000484068
  CDS Start-End: 1-485
gtcgttggaatcgtaagcctgataatcaaagtcttgggcatcgtggccgtcgtccaagtggccctgatggggcagcgagagaacatatccttaggcagcttccaattacttatccatctgcagaagaagacttggcttctcatgaagattctgtgccatctgctatgacaactcgtctgcgcaggcagagcgagcgggaaagagaacgtgagcttcgggatgtgagaattcggaaaatgcctgagaacagtgacttgctaccagttgcacaaacagagccatctatatggacagttgatgatgtctgggccttcatccattctttgcctggctgccaggatatcgcagatgaattcagagcacaggagattgatggacaggcccttctcttgctgaaagaagaccatctcatgagtgcaatgaatatcaagctaggcccagccctgaagatctgtgcacgcatcaactctctgaaggaatcttaacaggaacatgaagccttgataaaacagcagttttacttttctcacaaaaacttgtaagatctgatcatagagaggtggacatatgattgaagtcaggttgaacagtcattccccgggactgtatatttgaagaagttaggagatgctttaagtaagtgtaattaattatgaaagccctgagctgctggcagccagaacacccactttgtggacacaaaatggaaaccgacaactcagagagattctcctagtagtttactaagtaagttcttgccaatatccagcttgttcttagaatggctcaggttgagtttgtattacctgctactcaaagaattcttgactgactctccaggagcatttcccaacttgtctttatagatgcttaattaattaattttagctaattaaagagacttgtgtgctca

SEQ ID NO: 167324 - DNA, 2595 bp, Homo sapiens
  Payload ID: 12923
  Gene Symbol: PHC3
  Gene Name: polyhomeotic homolog 3 (Drosophila)
  ENST ID: ENST00000467570
  CDS Start-End: 35-2521
atgcgcagcccatgttagtgatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctctgattttcacacccgctaccactgtggctgctgtacagtctgacattcctgttgtctcgtcgtcatcgtcatcttcctgtcagtctgcagctactcaggttcagaatttaacattacgcagccagaagttgggtgtattatctagctcacagaatggtccaccaaaaagcactagtcaaactcagtcattgacaatttgtcataacaaaacaacagtgaccagttctaaaatcagccaacgagatccttctccagaaagtaataagaaaggagagagcccaagcctggaatcacgaagcacagctgtcacccggacatcaagtattcaccagttaatagcaccagcttcatattctccaattcagcctcattctctaataaaacatcagcagattcctcttcattcaccaccttccaaagtttcccatcatcagctgatattacaacagcagcaacagcaaattcagccaatcacacttcagaattcaactcaagacccacccccatcccagcactgtataccactccagaaccatggccttcctccagctcccagtaatgcccagtcacagcattgttcaccgattcagagtcatccctctcctttaacagtgtctcctaatcagtcacagtcagcacagcagtctgtagtggtgtctcctccaccacctcattcaccaagtcagtctcctactataattattcatccacaagcacttattcagccacaccctcttgtgtcatcagctctccagccagggccaaatttgcagcagtccactgctaatcaggtgcaagctacagcacagttgaatcttccatcccatcttccacttccagcttcccctgttgtacacattggcccagttcagcagtctgccttggtatccccaggccagcagattgtctctccatcacaccagcaatattcatccctgcagtcctctccaatcccaattgcaagtcctccacagatgtcgacatctcctccagctcagattccaccactgcccttgcagtctatgcagtctttacaagtgcagcctgaaattctgtcccagggccaggttttggtgcagaatgctttggtgtcagaagaggaacttccagctgcagaagctttggtccagttgccatttcagactcttcctcctccacagactgttgcggtaaacctacaagtgcaaccaccagcacctgttgatccaccagtggtttatcaggtagaagatgtgtgtgaagaagaaatgccagaagagtcagatgaatgtgtccggatggatagaaccccaccaccacccactttgtctccagcagctataacagtggggagaggagaagatttgacttctgaacatcctttgttagagcaagtggaattacctgctgtggcatcagtcagtgcttcagtaattaaatctccatcagatccctcacatgtttctgttccaccacctccattgttacttccagctgccaccacaaggagtaacagtacatctatgcacagtagcattcccagtatagagaacaaacctccacaggctattgttaaaccacagatcctaacccatgttattgaaggctttgtgattcaggagggattggagccatttcctgtgagtcgttcctctttgctaatagaacagcctgtgaaaaaacggcctcttttggataatcaggtgataaattcagtgtgtgttcagccagagctacagaataatacaaaacatgcggataattcatctgacacagagatggaagacatgattgctgaagagacattagaagaaatggacagtgagttgctcaagtgtgaattctgtgggaaaatgggatatgctaatgaatttttgcggtcaaaacgattctgcactatgtcatgtgccaaaaggtacaatgttagctgttctaaaaaatttgcacttagtcgttggaatcgtaagcctgataatcaaagtcttgggcatcgtggccgtcgtccaagtggccctgatggggcagcgagagaacatatccttaggcagaagaagacttggcttctcatgaagattctgtgccatctgctatgacaactcgtctgcgcaggcagagcgagcgggaaagagaacgtgagcttcgggatgtgagaattcggaaaatgcct

SEQ ID NO: 167325 - DNA, 772 bp, Homo sapiens
  Payload ID: 12923
  Gene Symbol: PHC3
  Gene Name: polyhomeotic homolog 3 (Drosophila)
  ENST ID: ENST00000475729
  CDS Start-End: 31-772
gcagcccatgttagtgatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctatcaacctctccacttctcctacacctgcacagttaataagccgttcccaggcttccagttctaccagcggcagtattacccaacagactatgttactagggagtacttcccctaccctaacggcaagccaagctcaaatgtatctccgagctcaaatgctgattttcacacccgctaccactgtggctgctgtacagtctgacattcctgttgtctcgtcgtcatcgtcatcttcctgtcagtctgcagctactcaggttcagaatttaacattacgcagccagaagttgggtgtattatctagctcacagaatggtccaccaaaaa

SEQ ID NO: 167326 - DNA, 5030 bp, Homo sapiens
  Payload ID: 12923
  Gene Symbol: PHC3
  Gene Name: polyhomeotic homolog 3 (Drosophila)
  Uniprot ID: Q8NDX5
  ENST ID: ENST00000494943
  CDS Start-End: 70-3021
agtgatggaggagagaagatggcggaagcggagtgagtgactagatgatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctatcaacctctccacttctcctacacctgcacagttaataagccgttcccaggcttccagttctaccagcggcagtattacccaacagactatgttactagggagtacttcccctaccctaacggcaagccaagctcaaatgtatctccgagctcaaatgctgattttcacacccgctaccactgtggctgctgtacagtctgacattcctgttgtctcgtcgtcatcgtcatcttcctgtcagtctgcagctactcaggttcagaatttaacattacgcagccagaagttgggtgtattatctagctcacagaatggtccaccaaaaagcactagtcaaactcagtcattgacaatttgtcataacaaaacaacagtgaccagttctaaaatcagccaacgagatccttctccagaaagtaataagaaaggagagagcccaagcctggaatcacgaagcacagctgtcacccggacatcaagtattcaccagttaatagcaccagcttcatattctccaattcagcctcattctctaataaaacatcagcagattcctcttcattcaccaccttccaaagtttcccatcatcagctgatattacaacagcagcaacagcaaattcagccaatcacacttcagaattcaactcaagacccacccccatcccagcactgtataccactccagaaccatggccttcctccagctcccagtaatgcccagtcacagcattgttcaccgattcagagtcatccctctcctttaacagtgtctcctaatcagtcacagtcagcacagcagtctgtagtggtgtctcctccaccacctcattcaccaagtcagtctcctactataattattcatccacaagcacttattcagccacaccctcttgtgtcatcagctctccagccagggccaaatttgcagcagtccactgctaatcaggtgcaagctacagcacagttgaatcttccatcccatcttccacttccagcttcccctgttgtacacattggcccagttcagcagtctgccttggtatccccaggccagcagattgtctctccatcacaccagcaatattcatccctgcagtcctctccaatcccaattgcaagtcctccacagatgtcgacatctcctccagctcagattccaccactgcccttgcagtctatgcagtctttacaagtgcagcctgaaattctgtcccagggccaggttttggtgcagaatgctttggtgtcagaagaggaacttccagctgcagaagctttggtccagttgccatttcagactcttcctcctccacagactgttgcggtaaacctacaagtgcaaccaccagcacctgttgatccaccagtggtttatcaggtagaagatgtgtgtgaagaagaaatgccagaagagtcagatgaatgtgtccggatggatagaaccccaccaccacccactttgtctccagcagctataacagtggggagaggagaagatttgacttctgaacatcctttgttagagcaagtggaattacctgctgtggcatcagtcagtgcttcagtaattaaatctccatcagatccctcacatgtttctgttccaccacctccattgttacttccagctgccaccacaaggagtaacagtacatctatgcacagtagcattcccagtatagagaacaaacctccacaggctattgttaaaccacagatcctaacccatgttattgaaggctttgtgattcaggagggattggagccatttcctgtgagtcgttcctctttgctaatagaacagcctgtgaaaaaacggcctcttttggataatcaggtgataaattcagtgtgtgttcagccagagctacagaataatacaaaacatgcggataattcatctgacacagagatggaagacatgattgctgaagagacattagaagaaatggacagtgagttgctcaagtgtgaattctgtgggaaaatgggatatgctaatgaatttttgcggtcaaaacgattctgcactatgtcatgtgccaaaaggtacaatgttagctgttctaaaaaatttgcacttagtcgttggaatcgtaagcctgataatcaaagtcttgggcatcgtggccgtcgtccaagtggccctgatggggcagcgagagaacatatccttaggcagcttccaattacttatccatctgcagaagaagacttggcttctcatgaagattctgtgccatctgctatgacaactcgtctgcgcaggcagagcgagcgggaaagagaacgtgagcttcgggatgtgagaattcggaaaatgcctgagaacagtgacttgctaccagttgcacaaacagagccatctatatggacagttgatgatgtctgggccttcatccattctttgcctggctgccaggatatcgcagatgaattcagagcacaggagattgatggacaggcccttctcttgctgaaagaagaccatctcatgagtgcaatgaatatcaagctaggcccagccctgaagatctgtgcacgcatcaactctctgaaggaatcttaacaggaacatgaagccttgataaaacagcagttttacttttctcacaaaaacttgtaaggtaaaggcctaacttggtctagaatatgacacttattgtggtggatagccaagcacattgggatctccacatcaaatactgacatttcttctacaggtataataattcatcatgcattttcataattaataaacattggtaaaattaattttacaggttacatgaaacattgaaagacttgttacagagggccatgatatttttcaaagaaatgtgttatactagataatttttttaaaggtgatgtttatcattaatataaagaatccttttaaaagtaatttaatgatttacatttctcctcttttgattcaattttcttatacattttttctaccctattagttttctaaaggttgtcatgagaggtatattatggaataatttagtagtccagtgacagaatcgtatgaaatcagtgtacattttaaaaaacatgtcttttagacatatgctttatctataaaaaaggaattgtgttctagtatgaacaatactgatctggaagtgagaagagttagtttctattccaaacttgaccaagaatttggtttgactgagaacgttttcctctcagtttttgtacatttatttagagcagtggttctcagtggaggtcagttttgatcgccaggggacatctggcaatgttgagacattttggttgtcacagcttgggggtgggttcaggggagggttgctactggtgtctagtagttagaagccagagatgtttctaaacatcttataatgcacaggacagcacccctccactgtaaagaattattggttcaaaaatatcggtactgccaaggttgagaaactctgatatagaaggagtgataaatattgttttcacccaaaggaatacttttaaaggatgaagcttactaaacatatatgatggaagtattattcagataacattaatattctgctgaataattttttctagtttaatcatactagaaaaagaaaaaaaatctacaaattgtcctataaaataaggacaaacatgcaaataatttaactctcagaaagtactaattcattctgattatctttcatacctctgtgctcctctgcactgacgaagacataatatgattatacctatgaactagtgcacagccttttctggcaagaaaatagtttgtagcagatacgtggttgctctttggatttttttctattgttgaacatgctgggactagctagaatgcacattcctacttcctttaccaaacgtttgcatgcttcctgcaaagcacttaccaagtgatttctcttgaaccatcggatataattttgtatgtacatgtttgaggaaaaaaatgtaaagcaaaaccttttactgaacagtgttctatagaattatgacactaaaacaaaattgtttgtggaagccctgaaagctttatagtcctggacatcaaaaattttatttgagatgatgaatgttttgttttcatcttttcttatattaccacaattgagatattttagtaattgaaggaacatacacagatatttggcagaagtcgagtaaggaggggaaaaaaagagtccgtgagtttcagtcattttcactgctcttttcaaaaagattgtgttgagctggtagaagactaaagatgtcactgaagacatcacagatactatatttatcttttggctttgtgtacattagagaatgttgattatttttatacaaaaatacagcgggtaatttttttaatctttagatgcctcttgtttgaatgtatgctttgtggaattctttgtgtagtaatgttttaaaaaaagatgtttactgatagttacatgtaggattagaatatgtaatataatataaggctcatgttccagacctacgatagcttgtagtctatgttacgtatttctttatatcacatttttaatcattggattaaagtatcaaggaaagcta

SEQ ID NO: 167327 - DNA, 12666 bp, Homo sapiens
  Payload ID: 12923
  Gene Symbol: PHC3
  Gene Name: polyhomeotic homolog 3 (Drosophila)
  Uniprot ID: Q8NDX5
  ENST ID: ENST00000495893
  CDS Start-End: 33-3020
gcgcagcccatgttagtgatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctatcaacctctccacttctcctacacctgcacagttaataagccgttcccaggcttccagttctaccagcggcagtattacccaacagactatgttactagggagtacttcccctaccctaacggcaagccaagctcaaatgtatctccgagctcaaatgctgattttcacacccgctaccactgtggctgctgtacagtctgacattcctgttgtctcgtcgtcatcgtcatcttcctgtcagtctgcagctactcaggttcagaatttaacattacgcagccagaagttgggtgtattatctagctcacagaatggtccaccaaaaagcactagtcaaactcagtcattgacaatttgtcataacaaaacaacagtgaccagttctaaaatcagccaacgagatccttctccagaaagtaataagaaaggagagagcccaagcctggaatcacgaagcacagctgtcacccggacatcaagtattcaccagttaatagcaccagcttcatattctccaattcagcctcattctctaataaaacatcagcagattcctcttcattcaccaccttccaaagtttcccatcatcagctgatattacaacagcagcaacagcaaattcagccaatcacacttcagaattcaactcaagacccacccccatcccagcactgtataccactccagaaccatggccttcctccagctcccagtaatgcccagtcacagcattgttcaccgattcagagtcatccctctcctttaacagtgtctcctaatcagtcacagtcagcacagcagtctgtagtggtgtctcctccaccacctcattcaccaagtcagtctcctactataattattcatccacaagcacttattcagccacaccctcttgtgtcatcagctctccagccagggccaaatttgcagcagtccactgctaatcaggtgcaagctacagcacagttgaatcttccatcccatcttccacttccagcttcccctgttgtacacattggcccagttcagcagtctgccttggtatccccaggccagcagattgtctctccatcacaccagcaatattcatccctgcagtcctctccaatcccaattgcaagtcctccacagatgtcgacatctcctccagctcagattccaccactgcccttgcagtctatgcagtctttacaagtgcagcctgaaattctgtcccagggccaggttttggtgcagaatgctttggtgtcagaagaggaacttccagctgcagaagctttggtccagttgccatttcagactcttcctcctccacagactgttgcggtaaacctacaagtgcaaccaccagcacctgttgatccaccagtggtttatcaggtagaagatgtgtgtgaagaagaaatgccagaagagtcagatgaatgtgtccggatggatagaaccccaccaccacccactttgtctccagcagctataacagtggggagaggagaagatttgacttctgaacatcctttgttagagcaagtggaattacctgctgtggcatcagtcagtgcttcagtaattaaatctccatcagatccctcacatgtttctgttccaccacctccattgttacttccagctgccaccacaaggagtaacagtacatctatgcacagtagcattcccagtatagagaacaaacctccacaggctattgttaaaccacagatcctaacccatgttattgaaggctttgtgattcaggagggattggagccatttcctgtgagtcgttcctctttgctaatagaacagcctgtgaaaaaacggcctcttttggataatcaggtgataaattcagtgtgtgttcagccagagctacagaataatacaaaacatgcggataattcatctgacacagagatggaagacatgattgctgaagagacattagaagaaatggacagtgagttgctcaagtgtgaattctgtgggaaaatgggatatgctaatgaatttttgcggtcaaaacgattctgcactatgtcatgtgccaaaaggtacaatgttagctgttctaaaaaatttgcacttagtcgttggaatcgtaagcctgataatcaaagtcttgggcatcgtggccgtcgtccaagtggccctgatggggcagcgagagaacatatccttaggcagcttccaattacttatccatctgcagaagaagacttggcttctcatgaagattctgtgccatctgctatgacaactcgtctgcgcaggcagagcgagcgggaaagagaacgtgagcttcgggatgtgagaattcggaaaatgcctgagaacagtgacttgctaccagttgcacaaacagagccatctatatggacagttgatgatgtctgggccttcatccattctttgcctggctgccaggatatcgcagatgaattcagagcacaggagattgatggacaggcccttctcttgctgaaagaagaccatctcatgagtgcaatgaatatcaagctaggcccagccctgaagatctgtgcacgcatcaactctctgaaggaatcttaacaggaacatgaagccttgataaaacagcagttttacttttctcacaaaaacttgtaaggtaaaggcctaacttggtctagaatatgacacttattgtggtggatagccaagcacattgggatctccacatcaaatactgacatttcttctacaggtataataattcatcatgcattttcataattaataaacattggtaaaattaattttacaggttacatgaaacattgaaagacttgttacagagggccatgatatttttcaaagaaatgtgttatactagataatttttttaaaggtgatgtttatcattaatataaagaatccttttaaaagtaatttaatgatttacatttctcctcttttgattcaattttcttatacattttttctaccctattagttttctaaaggttgtcatgagaggtatattatggaataatttagtagtccagtgacagaatcgtatgaaatcagtgtacattttaaaaaacatgtcttttagacatatgctttatctataaaaaaggaattgtgttctagtatgaacaatactgatctggaagtgagaagagttagtttctattccaaacttgaccaagaatttggtttgactgagaacgttttcctctcagtttttgtacatttatttagagcagtggttctcagtggaggtcagttttgatcgccaggggacatctggcaatgttgagacattttggttgtcacagcttgggggtgggttcaggggagggttgctactggtgtctagtagttagaagccagagatgtttctaaacatcttataatgcacaggacagcacccctccactgtaaagaattattggttcaaaaatatcggtactgccaaggttgagaaactctgatatagaaggagtgataaatattgttttcacccaaaggaatacttttaaaggatgaagcttactaaacatatatgatggaagtattattcagataacattaatattctgctgaataattttttctagtttaatcatactagaaaaagaaaaaaaatctacaaattgtcctataaaataaggacaaacatgcaaataatttaactctcagaaagtactaattcattctgattatctttcatacctctgtgctcctctgcactgacgaagacataatatgattatacctatgaactagtgcacagccttttctggcaagaaaatagtttgtagcagatacgtggttgctctttggatttttttctattgttgaacatgctgggactagctagaatgcacattcctacttcctttaccaaacgtttgcatgcttcctgcaaagcacttaccaagtgatttctcttgaaccatcggatataattttgtatgtacatgtttgaggaaaaaaatgtaaagcaaaaccttttactgaacagtgttctatagaattatgacactaaaacaaaattgtttgtggaagccctgaaagctttatagtcctggacatcaaaaattttatttgagatgatgaatgttttgttttcatcttttcttatattaccacaattgagatattttagtaattgaaggaacatacacagatatttggcagaagtcgagtaaggaggggaaaaaaagagtccgtgagtttcagtcattttcactgctcttttcaaaaagattgtgttgagctggtagaagactaaagatgtcactgaagacatcacagatactatatttatcttttggctttgtgtacattagagaatgttgattatttttatacaaaaatacagcgggtaatttttttaatctttagatgcctcttgtttgaatgtatgctttgtggaattctttgtgtagtaatgttttaaaaaaagatgtttactgatagttacatgtaggattagaatatgtaatataatataaggctcatgttccagacctacgatagcttgtagtctatgttacgtatttctttatatcacatttttaatcattggattaaagtatcaaggaaagctaggtactctataatgagttttcatttattagcagttaatcatcatgacagaattgtcatatgcttgacttttccctcttcttggaatttcagaacacaaatacaggctaagcattagtaagagatggcccacagtatgagagagagaggtgcaacggaaaatctcgcctggaattaaaacttttcatagattatccacggttaatacaaaatttattatatggggatagactgctccagcaataatgattacatcctataactgtattacctatggcctttaaggtatcaattttgaactgtgttgtaggctctccttttatttgttctctttcctaatagcagccattctgtacttattgaaagcccctgtgcctactgctgtcttaagtattcaggaggggcttacaagagggttttctattggagaataccgtataatcttaaatctagtccagatctctgttgtccccactcaaaacatacacaaaatatgcacttgcttttttcaagtgagtttttatttaaaaatggcttgtttgctatcacattggtgcagctgtttctttcaagatgagttaatcatcttaatttcaaagcttcagctatatataatggatatatagacaacactgagcatccacctctctcctgagctttaaagcagagtttcagtatgatataggtggggagagtaaattgttttcatatcctttcatactactactaatagttttaggattttgactggggagagataatgacaaacagaaagggaacatggaggttcttcctacttttgctacctaagtttgcattttctgacttccttgcagtgttgcactctttgtcccattgggataaaaagcataagtttgaaattttgctttaagccttgtgttcctggggaagttaaacaactaagagagctgatttgtaaaaattattttttatatgacattaatattcatcaagccttgtgtaggcatgtgtaagacacagctatgcagctttgagtagtcaatatagtatgagatagagtgttgtcccaaatcctcctgtcactttttaagtagcatattatttccctgatggtcctgttactttgctgttgaatgctctaaacagaactttttaaaaggtgtgttttaagagcagtcacctaggagtagacaaggtggaatgggaggagagaaatggtaatgcaaaagcttgagcatgggaagagtcagaggaggaggccatcatccttgttagcttagcctacttcaacactgagcacatttctgcacttttgaagtgaaattcatgttttacttagaagaaataattttctttcattagggatcccagttgatttttgtttcctggtgtatcaaaatacttagaactatgaaacaagtattattgtgatcatgcctttgaataatttttgacgtagcttatcttcatgtatcaagtataaaattataatgagacatctattcacaaatacaagtcttagattgaattgaaatgtgttatagtgccctgtctcccactgacttgttcagttaaatgtcttaaagtacattatgtacatcttcaggcttttggtaccacaatggcacaagtatggtagggaggcaatatagtcttaggctatatgcctatattaagtgtgtataaacaatttttgaaagaatacactattatagatgtatgtgagtgatgctgacctgacagccatatccagtggatgaaactgactggacacactgttaaaatgttttaaagatgtattttcagccagaacagcctggttatagtttgtggttttcaccttggtggattgcaggaacacatgcagcctactggcattgagcattagctaatggcatgaaagggcctcatctcactacctctctaaggcctctagctccaagaaaaccatgaaaacttctttcttggagagatctttgtctcagaatccttagagaggatttcgtatgggggctaactttaggaagggaggcagctggggcaggactttctgatacctgacagtcatgttccagagcaacctttgggcagtggaaactggcgcatctatgcaaaatgattgctcaatctctatcttgtgtactacatatgtaactagctgggccctaaggaaggttttctagggggaaggatagggaagtagaggaggagacaagtaggaggaacaaagcattctagacccaagaggatagaagatatttaggatagatatggctttcatccatagttcaaaataatgcgttttgttagatgccagttatagcagtaaataggttatagtttttatatgtcaagatttacctgtaatcagactcattctttcactctctatacccactgtctccatgcttgggagcatggatattaatagttccagtgatgtagaagttagtgatttttgatttctgaaaaaggtgagaaccttttattacagttggagaatatttgtcaaaaattcaaaggttgttgtaattgagttgccagaattacagagtttccattttcagatatcacagttgaatcacctctgtagattgttataaagagaggcattttaagatagtattttatttgctaggttgtgtctcagtctaagaattgggaaaagaagagctataggtttctctttcctagtctggatttcagtaaacacaagcctacctctgcttctttggttcacagcagtgtggatcatgaaatgaactgtttacccacattcatcaatattggtattttacaaatctacttggagcatttaatttcatctcaaagattgtgatccactttagataagcacaaatacagtattaggaaaagtaaatatgcaatcttactaaaatttcaacttgttaagctgtatatcttaaaagaaattatttggggctgggcatggtggctcacacctgtaatcccagcactttgggaggctgaggtgggtagatcacctgaggtcaggagttcgagaccagcctgaccaatatggtgaaaccctatctctactaaaaacacaaaaattagctgggtgtggtggcatgcacctgtaattccagctacttgggaggctgagacaggagaattgcttgaacccaggtggtggaggttgcagtgagccaagatcacacccctgcactccagcctgggtgacagagcgagactccatctcaaaaaaacaaaacaaaaaattatttgggaagatacgtcctcttttattagaagttcataaaatgtatcatatagttttgttcacagtagttatataagctttcttcaaataaatttaaaattagattaccttctttggaaaaagaatttcctaaatttttaagaattttcaaagttttacatattagtttttagaacctaatccgttttaaaattgtactatgagaaagcttttttttgaaagttgtaaagcattaatacaaataatacaaatataattattaccatcacattccagagaatatggctttttctaaactttcaatttagaaaacatacattaagggagaatctctgccctccttttcagctctgaagatcagcttttctactcagacacatgcacacaccccttccaagtgtcatgtttatgggaacatttgggaaatgttttccagatgttttattttttcccttttatagtttgttgacatttaattttacttaaagatgacaattttaatcggaaatgttagaggtacaacatagtgaggttctagctagctttatacttttgaaaaatatttttgtttctactgctttttacaagtactagtcctctcagtgatactggtggtgttcagtatgaatccatagaaagaaaacaaaatttgttgtttaaaaaaagcagagtaatgaatgaatttcagttttgaaaacaacataatttgaaaacactgttatactaacatggcaaggtgttaattaaatataagagtaaggtagtaagttcttttagagcacctgtttaaatttactccagtaatcatcttaaggattgatagtcaccatcacttattggcttaaaagttatatttcatggaatattatcagtgttaaatccaagctttgtggagctttaagtgatggtggtgaaaaagttggtgtttatgagagagtggtggggtgtctagtcattagtgaagttaaacatcaacctgttttagaaagaattttttagtcttgcctaaagtaaaccagaagtgtctagtgtttaaatctttatttagaatgcttctcttaaaagtattttttgttttgggtagtattaaataatcagtaaataatctatttcagtagtaaataatgaattaagatgatgatgaatgaggattaacacactggtctggagactggggttttatttcagtgggttagctgtgtgtgacatgttgggcaattactcagctgttttaacagcttccagatatgcagtatggtgcctgtactactcaaaagttgattttggtttaattcatctttaaggtacctcccagctctaaaactatgattctaggctgtgtaatggggttattcctactttattctctttccttttttaagggttcattttatacttaataagcatccatttcttgggtcacctacagtctttgttctcctaaggattaaaatagaaaattcatacataacaagcaaatgatgacattttcctaaatgctccttattggttaaccactgaatatatgaacacatatgaatattgtcattcatgtacttaaattcatttagcaaactatttgaacacttacatgtgcagtgtttggtgaacatgacatgaggaactagtagtaagtaaaatcttccccccaaaattcattgtggcttaaataaatatgaacataatcattactacttaatatactgagagggaatcttaataaacttggaactgggagggaatatttgtatacattgggtaaagggttaggctagatgacatctaaggggtctgagtgaatcatatcataatttttataacacatttcacatactaaacatcagttggccccatacctgattaagttacaaaatttaggagacttaacattaaggacttacaggttgagacagcccgtatttcacaacattattttgacacttgactctattccagagttgttgctatacaaggcatgtggcagaacaaaaaaaaagctggtgttgatataagagctttttacccagtattgacagtgagcaactttctttctttttttttttttttcttttttttttttttgagatgggttcgctctgttgcccaggctggtgtgcagtggtgcgatctcagctcactgcaacctccacctcccgggttgaagcgattgtcttgcctcagccttccaagtagctggaattacaggtgcccgccgccacacctggctaatttttgtatttttagtagagacggggcttcaccatgttggccaggctagtctcgaactcttgacctcaagtgatccacctgccttggcctccctaagtgctgggattacaggcatgagccaccacacctgtccgacagtgtagcaactttctaaaactgaaaaatctcaaaggagatcattggaactgacttgttcatttattttttgtttttaaattaagaaagattacacaaaataagtgttactgtactttaagctattacaaatatccaacttttaaagatatgtaagaatcagtaatattctagaaagcacatatatagtaaaagggcatcctttaaatgtagaacgggtaaacatgaaacagttccatgcttgaattgttaagtatctagggggtaaacattgaatgggagaatcatttattgggttaaggtcccttccttgtcattctgggatctgtgaatcacattgtaattcctgttgacaaagctttacttgttaacatcagttgatactgacattctccataaagatatagaatgaaaatatctattaaaaatagtttatcattgttttagcttttttgttttgtttgttttgagacagagtctcactgtcacccaggcttgagtgcagcggtgtgatcttggctcaatgcaacctccacctcccaggttcaatagattctcccaccttggcctcccaagtagctgggattactggcatgcaccactatgcctggccagttttttgtatttttagtagagatggggtttcaccatgttggccaggctggactcgaactcctgacctcaagtgatccgcccacctcagcctcccaaagtgccgggattataggcatgagccactgcgcctagcctgttgcagctttttaaagcaggaaaatatccatataaactgttgggttagaatctatattagaatctttcaaactaattgaaaacaggaagactatcatctaagtagccagataatctgggtttcaaaaagttattccatggtactggtttaaaaaatacttttcaagtgttttaatttttaaagtgtaactaattcttcaaatatgttatgctgttaaaatatgtattccataagtactttttgtatatgtattcttaaattttaaaaagtcaactgaatgcgcaaagatgatataattttggatgtagacatttaaactagattcccagtcctctccttcaaaagcttggtctttgtttttcctatagggaaaaaagtcaaaataagttccaaaaactatcctcaaagtagtattgtgcttgtagtaaatgaaggttggatggatggatactgacaatggtggcaggcatttcaagccttttaaattagtactttttgtcgtcttgcttattaaaattttgttaattttagcaaagaccaattgttgtgataaactggtgttttttggatgcttcaagcacacgttaaccaattttttaattccccttttggttcctcccattgttctaaaataggactttcatattattaaaacctcaaaagatgatccacccaggatgaacaaagatcaccaaggggaaagaaaacattttttatctttacagaaaacatgttaagattatatatagatgtattctttacattggatattgtattagagtcctccttacaagaaatgaaatagtttttagcactcttagcattagagttcctagattggtgttgatagctacagttttaaaatgtataacctgaaaatgaaggttaattttgcattgtaagagcacatttgatctatgtaaaaagtgtccatttggtgtatttttttaaaaaagagaaagcactttcatattaagtagcatgtgtatgaatttagattttcatatttgttgtgtctgtattcagtgaagtaaattgagcatttaaatgtttgttgatggcaacattaactattaaattaaagcaccttatactctgctgcttaacttgcttgtaattgcacctttgttacctgcacattttcatatagaatattgttgtaacattgcttcatgtgggtctggatggaagattagtgggcctacaggatcatttatttatattgtttatattacaataatatattgtagatcagttgtaagttcatttctttacaaataaaagcctcttccatttga

SEQ ID NO: 167328 - DNA, 2087 bp, Homo sapiens
  Payload ID: 12923
  Gene Symbol: PHC3
  Gene Name: polyhomeotic homolog 3 (Drosophila)
  Uniprot ID: Q8NDX5
  ENST ID: ENST00000497658
  CDS Start-End: 19-474
agtgatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctgtaagttccctaaatttttttttcctggatttaaaattttaaagaattgttttccaaaagtaaactgttgttatttatgaagctgttattataatttgttgcatgctgtttaaagtaacaattgcccagaaatagaaatgataaaattcaagaattcagaactaatgttaaacttatgaaaatctgagtcttaaaaaaatctttttgtattatttcttgtatatccatttgcactgatcatgttcagatcttatgtggtttcagctttctgtgtgtattgaaagcctaaaatatacaatgcagggatattggccatgaatttactgtgatatacaatagtatgtcatgtccttggtagacatctaagcatttctaactttgtgcaattcacattttagaaattatactttcagcttacatgagttatttgggttcaatttgcaagtatccattcaagatagggtaatttattttgagaaaggagtaaaagaaagctgattcgctatattgcacatatatattgggaaattgtgccaagtttcccaggtaaaataaatttatgggcatggtaatacttgtttagcttttaattttggtataattttaaactgcaataataataaaaaaatttctgtatctactctactcagattaatcaattattgcatattgccccattactttatcattcattcttttccactacatgtatacatatttttttctgagtcatttgtaagttgagatatgttcctttattcctaaatactttgatgtgtatttcctaagaacaaggctattgttttttgaagccacagaaaaattactaaattcaggaaatataacattgatacagtgcagttcattttcacatttcatcatttgtctcaggtttcccaacctcatcactatggacattatgagccagataattctttgttgtcaggggctatcgtgtaatttataggatgtttagcagcatccctggctactagatgccggcagcttgtggtctttctccttcctctagtgtgacaactataggtgtttcctggtggggggcaaactgcctgtagttgagaacctaataatgtcctttctagatattttttcctggtccagaatggtaatactttgatacttcataaaattggctccaatacaatatagtttgtaggttgttaaggaattgaaggttaaggaattgtgctctatttcttcagctaagggtatggtctttgctaactacatgctgtggtcagcatatagctgtggttttttttgttgtttggtttttttttctggctgttgatctgactttttttttttggcgtgggaatgtcctggagtgtgaacaagattagtttaaaaagttccctatgacttgaagatgttagattaaatgaaaaacttaaataatgtaacctagctcttaagcattaatactggagtttttgtcattgacatcagatgtctttaatacaatggtaattaaggaaaggagtggtaaatattttgtgggctactgaaggaaattatatagacaaattctttattctgtgaaatactggaataacaataggatgtatttgtatagatatgttattttgaatttttttccttcatgttattaaaaggtatctttttaaactgtc

SEQ ID NO: 167329 - DNA, 609 bp, Homo sapiens
  Payload ID: 12923
  Gene Symbol: PHC3
  Gene Name: polyhomeotic homolog 3 (Drosophila)
  ENST ID: ENST00000472330
  CDS Start-End: 60-233
gagagaagatggcggaagcggagtgagtgactagatgatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggagctatatagccttgggtatgagacataatccccttgagcctcagaaaactaaaatgagggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctatcaacctctccacttctcctacacctgcacagttaataagccgttcccaggcttccagttctaccagcggcagtattacccaacagactatgttactagggagtacttcc

SEQ ID NO: 167330 - DNA, 2289 bp, Homo sapiens
  Payload ID: 12924
  Gene Symbol: POLI
  Gene Name: polymerase (DNA directed) iota
  ENST ID: ENST00000217800
  CDS Start-End: 1-2037
gttcatgatcaagtgttgcccacaccaaatgcttcatccagagtcatagtacatgtggatctggattgcttttatgcacaagtagaaatgatctcaaatccagagctaaaagacaaacctttaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacagaaatggttgagaagagactacagcagctgcaaagtgatgaactttctgcggtgactgtgtcgggtcatgtatacaataatcagtctataaacctgcttgacgtcttgcacatcagactacttgttggatctcagattgcagcagagatgcgggaagccatgtataatcagttggggctcactggctgtgctggagtggcttctaataaactgttggcaaaattagtttctggtgtctttaaaccaaatcaacaaacagtcttattacctgaaagttgtcaacatcttattcatagtttgaatcacataaaggaaatacctggtattggctataaaactgccaaatgtcttgaagcactgggtatcaatagtgtgcgtgatctccaaaccttttcacccaaaattttagaaaaagaattaggaatttcagttgctcagcgtatccaaaagctcagttttggagaggataactcccctgtgatactctcaggaccacctcagtcctttagtgaagaagattcatttaaaaaatgttcatctgaagttgaagctaaaaataagattgaagaactacttgctagtcttttaaacagagtatgccaagatggaaggaagcctcatacagtgagattaataatccgtcggtattcctctgagaagcactatggtcgtgagagtcgtcagtgccctattccttcacatgtaattcagaaattagggacaggaaattatgatgtgatgaccccaatggttgatatacttatgaaactttttcgaaatatggtgaatgtgaagatgccatttcaccttacccttctaagtgtgtgcttctgcaaccttaaagcactaaatactgctaagaaagggcttattgattattatttaatgccatcattatcaactacttcacgctctggcaagcacagttttaaaatgaaagacactcatatggaagattttcccaaagacaaagaaacaaaccgggatttcctaccaagtggaagaattgaaagtacaagaactagggagtctccactagataccacaaatttttctaaagaaaaagacattaatgaattcccactctgttcacttcctgaaggtgttgaccaagaagtcttcaagcagcttccagtagatattcaagaagaaatcctttctggaaaatctagggaaaaatttcaagggaaaggaagtgtgagttgtccattacatgcctctagaggagtattatctttcttttctaaaaaacaaatgcaagatattcccataaatcctagagatcatttatccagtagcaaacaggtatcctctgtatctccttgtgaaccgggaacatcaggctttaatagcagtagttcttcttacatgtctagccaaaaggattattcatattatttagataatagattaaaagatgaacgaataagtcaaggacctaaagaacctcaaggattccactttacaaattcaaaccctgctgtgtctgcttttcattcatttccaaacttgcagagtgagcaacttttctccagaaaccacactacagatagccataagcaaacagtagcaacagactctcatgaaggacttacagaaaatagagagccagattctgttgatgagaaaattactttcccttctgacattgatcctcaagttttctatgaactaccagaagcagtacaaaaggaactgctggcagagtggaagagagcaggatcagatttccacattggacataaataagcatattcagcaaaaaggtctgaaaagcaagggaataccattattttcggattagcggtttattaagctcttctatattaaacactaatagatattcaataacggagtaaactgttccagataaagcaagaatagttgcaagaagtaaattctggcacaaagcgtaaaaatataacagaagaaataatgtaaaatactatcttttatgtctaaagccattttatattacttttcaataaaaagaatatcatg

SEQ ID NO: 167331 - DNA, 2030 bp, Homo sapiens
  Payload ID: 12924
  Gene Symbol: POLI
  Gene Name: polymerase (DNA directed) iota
  ENST ID: ENST00000406285
  CDS Start-End: 29-2014
aagtagcgctgcggttggcagcggcgggatggagaagctgggggtggagccggaggaggaaggcggcggcgacgacgacgaggaagacgccgaggcctgggccatggaactggcggacgtgggggcggcagccagctcgcagggagttcatgatcaagtgttgcccacaccaaatgcttcatccagagtcatagtacatgtggatctggattgcttttatgcacaagtagaaatgatctcaaatccagagctaaaagacaaacctttaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtgtattggctataaaactgccaaatgtcttgaagcactgggtatcaatagtgtgcgtgatctccaaaccttttcacccaaaattttagaaaaagaattaggaatttcagttgctcagcgtatccaaaagctcagttttggagaggataactcccctgtgatactctcaggaccacctcagtcctttagtgaagaagattcatttaaaaaatgttcatctgaagttgaagctaaaaataagattgaagaactacttgctagtcttttaaacagagtatgccaagatggaaggaagcctcatacagtgagattaataatccgtcggtattcctctgagaagcactatggtcgtgagagtcgtcagtgccctattccttcacatgtaattcagaaattagggacaggaaattatgatgtgatgaccccaatggttgatatacttatgaaactttttcgaaatatggtgaatgtgaagatgccatttcaccttacccttctaagtgtgtgcttctgcaaccttaaagcactaaatactgctaagaaagggcttattgattattatttaatgccatcattatcaactacttcacgctctggcaagcacagttttaaaatgaaagacactcatatggaagattttcccaaagacaaagaaacaaaccgggatttcctaccaagtggaagaattgaaagtacaagaactagggagtctccactagataccacaaatttttctaaagaaaaagacattaatgaattcccactctgttcacttcctgaaggtgttgaccaagaagtcttcaagcagcttccagtagatattcaagaagaaatcctttctggaaaatctagggaaaaatttcaagggaaaggaagtgtgagttgtccattacatgcctctagaggagtattatctttcttttctaaaaaacaaatgcaagatattcccataaatcctagagatcatttatccagtagcaaacaggtatcctctgtatctccttgtgaaccgggaacatcaggctttaatagcagtagttcttcttacatgtctagccaaaaggattattcatattatttagataatagattaaaagatgaacgaataagtcaaggacctaaagaacctcaaggattccactttacaaattcaaaccctgctgtgtctgcttttcattcatttccaaacttgcagagtgagcaacttttctccagaaaccacactacagatagccataagcaaacagtagcaacagactctcatgaaggacttacagaaaatagagagccagattctgttgatgagaaaattactttcccttctgacattgatcctcaagttttctatgaactaccagaagcagtacaaaaggaactgctggcagagtggaagagagcaggatcagatttccacattggacataaataagcatattcagcaaaaa

SEQ ID NO: 167332 - DNA, 577 bp, Homo sapiens
  Payload ID: 12924
  Gene Symbol: POLI
  Gene Name: polymerase (DNA directed) iota
  ENST ID: ENST00000580880
  CDS Start-End: 142-577
gcttaataaatcccaatccagcctagctgatttactgaagaacaaagggatgactagtttttgctacgccaaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtctataaacctgcttgacgtcttgcacatcagactacttgttggatctcagattgcagcagagatgcgggaagccatgtataatcagttggggctcactggctgtgctggagtggcttctaataaactgttggcaaaattagtttctggtgtctttaaaccaaatcaacaaacagtcttattacctg

SEQ ID NO: 167333 - DNA, 754 bp, Homo sapiens
  Payload ID: 12924
  Gene Symbol: POLI
  Gene Name: polymerase (DNA directed) iota
  ENST ID: ENST00000581950
  CDS Start-End: 1-258
gccaaatgtcttgaagcactgggtatcaatagtgtgcgtgatctccaaaccttttcacccaaaattttagaaaaagaattaggaatttcagttgctcagcgtatccaaaagctcagttttggagaggataactcccctgtgatactctcaggaccacctcagtcctttagtgaagaagattcatttaaaaaatgttcatctgaagttgaagctaaaaataagattgaagaactacttgctagtcttttaaacaggtgattttcaatccattttgccaagtcatcctatgtattcattctatatacgagtatgccaagatggaaggaagcctcatacagtgagattaataatccgtcggtattcctctgagaagcactatggtcgtgagagtcgtcagtgccctattccttcacatgtaattcagaaattagggacaggaaattatgatgtgatgaccccaatggttgatatacttatgaaactttttcgaaatatggtgaatgtgaagatgccatttcaccttacccttctaagtgtgtgcttctgcaaccttaaagcactaaatactgctaagaaagggcttattgattattatttaatgccatcattatcaactacttcacgctctggcaagcacagttttaaaatgaaagacactcatatggaagattttcccaaagacaaagaaacaaaccgggatttcctaccaagtggaagaattgaaagtacaagaactagggagtctccactagat

SEQ ID NO: 167334 - DNA, 6133 bp, Homo sapiens
  Payload ID: 12924
  Gene Symbol: POLI
  Gene Name: polymerase (DNA directed) iota
  Uniprot ID: Q9UNA4
  ENST ID: ENST00000579534
  CDS Start-End: 144-2366
atgcgtgtcactctgggcaacaggctggtcggccacgactgcgcaggcgagaggcacagagcgactggagactgtagtcccccggtttccctggagaccaggcggaagcggccggaagtagcgctgcggttggcagcggcgggatggagaagctgggggtggagccggaggaggaaggcggcggcgacgacgacgaggaagacgccgaggcctgggccatggaactggcggacgtgggggcggcagccagctcgcagggagttcatgatcaagtgttgcccacaccaaatgcttcatccagagtcatagtacatgtggatctggattgcttttatgcacaagtagaaatgatctcaaatccagagctaaaagacaaacctttaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtctataaacctgcttgacgtcttgcacatcagactacttgttggatctcagattgcagcagagatgcgggaagccatgtataatcagttggggctcactggctgtgctggagtggcttctaataaactgttggcaaaattagtttctggtgtctttaaaccaaatcaacaaacagtcttattacctgaaagttgtcaacatcttattcatagtttgaatcacataaaggaaatacctggtattggctataaaactgccaaatgtcttgaagcactgggtatcaatagtgtgcgtgatctccaaaccttttcacccaaaattttagaaaaagaattaggaatttcagttgctcagcgtatccaaaagctcagttttggagaggataactcccctgtgatactctcaggaccacctcagtcctttagtgaagaagattcatttaaaaaatgttcatctgaagttgaagctaaaaataagattgaagaactacttgctagtcttttaaacagagtatgccaagatggaaggaagcctcatacagtgagattaataatccgtcggtattcctctgagaagcactatggtcgtgagagtcgtcagtgccctattccttcacatgtaattcagaaattagggacaggaaattatgatgtgatgaccccaatggttgatatacttatgaaactttttcgaaatatggtgaatgtgaagatgccatttcaccttacccttctaagtgtgtgcttctgcaaccttaaagcactaaatactgctaagaaagggcttattgattattatttaatgccatcattatcaactacttcacgctctggcaagcacagttttaaaatgaaagacactcatatggaagattttcccaaagacaaagaaacaaaccgggatttcctaccaagtggaagaattgaaagtacaagaactagggagtctccactagataccacaaatttttctaaagaaaaagacattaatgaattcccactctgttcacttcctgaaggtgttgaccaagaagtcttcaagcagcttccagtagatattcaagaagaaatcctttctggaaaatctagggaaaaatttcaagggaaaggaagtgtgagttgtccattacatgcctctagaggagtattatctttcttttctaaaaaacaaatgcaagatattcccataaatcctagagatcatttatccagtagcaaacaggtatcctctgtatctccttgtgaaccgggaacatcaggctttaatagcagtagttcttcttacatgtctagccaaaaggattattcatattatttagataatagattaaaagatgaacgaataagtcaaggacctaaagaacctcaaggattccactttacaaattcaaaccctgctgtgtctgcttttcattcatttccaaacttgcagagtgagcaacttttctccagaaaccacactacagatagccataagcaaacagtagcaacagactctcatgaaggacttacagaaaatagagagccagattctgttgatgagaaaattactttcccttctgacattgatcctcaagttttctatgaactaccagaagcagtacaaaaggaactgctggcagagtggaagagagcaggatcagatttccacattggacataaataagcatattcagcaaaaaggtctgaaaagcaagggaataccattattttcggattagcggtttattaagctcttctatattaaacactaatagatattcaataacggagtaaactgttccagataaagcaagaatagttgcaagaagtaaattctggcacaaagcgtaaaaatataacagaagaaataatgtaaaatactatcttttatgtctaaagccattttatattacttttcaataaaaagaatatcatggtcaacatagaatatttttcatgaattggtggggagatgtatatgtttatatataaaaaatagccaaatcgttgcaatgatatggtaaaggacacattttttttttttttttcctgtgaaatgtggaatatctcaaattcagcctcttaggctgaatagcaaatcctactgccaactaacctattaaaaatatagatagttttgactaaagtactacattacatttagtatgttgacttttaaaataccaaagcaatttatattcaattaatgcttcttcatacaccaagaatctaccacaatacacagcacacaaaggccgttcaataaacattgaatgaatgaatggtttggctagggccagggtggggagttaaagtgagaggagggtatatgttatagagaacagtggtagaaggaactctccgtgcaagtaaattaagggaaagatggacaccagaaaggcaaggtgatgggcctataagcatactggataatggaagaagtccatttctttctagctagtttgaagggcctaaaagcactgagatgtttttgtatcttccctacatttggagatgatattaggttgtcataacaaccacaaatatagaccattactaaattggtggatgtcctctttctcccattgttattgccttcctcttttgcctgctaaactaaaaattggatataagattgagaatgtattatataatttgcaagacatagaggatgtttatagaatatactaaagtatccctcagcaccaatatgggagtatcctggtctcaagtttataatttttgcacatataatctaaagaagagactttaaaaataaagtacacaaatatgaaccaaagagtagcttaaaaatactttcttctaggtctgaaattttcttttctttctttttttgttttggagacagagtctcactctgtcgcccagggtggagtacagtggcgcaatcccagctcactacaacctccgcctcccaggttcaagcaattctcctgcctcagcctcctgagtagctgggattacacgcatgccctaccacacccagcaaatttttgtatttttagtagagatgacatttcaccatattggccaggctggtctcgaactcctggtctcaggtgatcctccaccttggcctcccaaagtgctgggattacaggtgtgagccattgctcctggccccagctctgaaattttaacttagttttggattccttggaatttgaaaatatgctaacacgaaggattgtaaataggtagtttgaggttatcaggaacagtaacttgaagcaagaacatcagaaattgttcaccatgcaaatatttagtactctgaatcaaggaacatagtattttttacatgagtattccagtaaggtaattaaacttatgaaaagggtatataactttttgtaaatcattaaaacattttatagtccttgtaatgatttcaggaccttggacagctagaaggggcttaagaaaaaatggctaagaaaacaaagtaaatggttttggccagcttaaaaagagaaagcaaaatagttaaaaatacatttcatagattgagaatgtacgggctatgtcacagttacgctacttattttgtggttttaagttagtctcaacatctttgggcctcagaatcaacttttttatgggatcttttttctctgtttttaagattatctcttttttctttggtgctttgcaggtttactgtattatttggaagtgcgaatttatttttattcttagtatatactggcttcttcctgtatcttttaattcatgttctgtaaaattctcaaccactagctcttcaaatatttcttctctattctaggactgtatacaaatgatagactttcttactgtatccttcatgtctcttaatttctcatatttttcatcctcttgtttctctttactgcattttgggtaatttcatcagctctatctttctgtttactagttcatttttcagtagcatctcacctgctatttaaaacaatgatggttttaatttcaataaatatatttttcatttgattctttttaacttcccgtttactcattacagtcccttgtaagtctgtttctaatttttaaaagtcaaatatatgatatttttgataatttcaatattttaagtctttataagtctacatttaaggttattattgcatatcattgtgacttatttccttgagtatgtgttaatctgcgagaagacagagggcctaaattgtgtatgttttccttcagtatgatttgagttcgttgcttctctgggtgaggtggtacaaactccttggcatactctattcacctttgtggatcctgattgaatgccttgtcttaagtgtaagctccctgacccttactactagccgaaggttttgtctctgcaggtcaattccaaactaacaggcagatgctgttagctatctgcctccagggataaaccccatctttcaagcttgcttcttgcttgatgctttctgctgctttcttgcttttgtttcagctcgagtttgttgttgttttttttttttcctgtttctgtcttgaatgtagagggtatttttatttttattttttctgtttctctcttgagtgtatagtgtagagggggtttctgtcttgagtgtaggcctggagatttcccttatatggtacaaaccagcaatgaattaagaggtctcttttctccaagatctagtgttttgtactaggagaactctaaaaagtatctattccactgtagtgccaaagtacaaatttatttggatttattttttgccatcttattttttaatatatttctttttctatgttgtgcttctttcccacctttatctctcctcctatcttttgggatcagttgggttttctatttaatcatatattttccctttactgatttggaatgtgaatgttacaagtccttttgattatccttaaacatctaaaaatgctaccctctttccaaacaacacaaaggtattgaaataacattaattctaattaaattccacaagttctttattaaatctccaaattggatattattagtattttatatagtcaatgtttatttttttgatgggacatggtgggggcttaccttttttcttgtgtgtcagatgttccttctaggtagaattctttataccttctgaaattatgtccttagagctgtagatttagaactgacatctcttgagctgttctaagataatatcttttactttggagatacgcagtttttattatatgtctagctatagatttatcatggatttaggttcattatgaatctgcagatttgtgtcttccatcaaatctggattgttttcaatattaaaaaaacttctattttaaaatctgtatatagaaaggtacataaacataaatgaacatgttaatgagtaattgtaacaactatgtaactgtccaagtcaagaaataaaacatatcaagtaa

SEQ ID NO: 167335 - DNA, 2705 bp, Homo sapiens
  Payload ID: 12924
  Gene Symbol: POLI
  Gene Name: polymerase (DNA directed) iota
  ENST ID: ENST00000579434
  CDS Start-End: 535-2448
gccggaggaggaaggcggcggcgacgacgacgaggaagacgccgaggcctgggccatggaactggcggacgtgggggcggcagccagctcgcagggtgcgccgcagccagaggagccagcggcctccttgggtgtaaatgagaagggtggggcaggcggacgctcggggcggcggccactggggcgcgaccgtccccgccccactcggctcctctaagagagggctgcctccctctgccttgtgttacgcggcgggtacctctagaggaatggcttcacccagcaggagtagggtggggcgcgtccacactacaaatacgtgtcgagggtttatctgcgccgtcctttcctctgtgaggggcgaggtggggcgggaatccctcagccagcccgacgaaaactgcagaggcttctgggccttttaactttggagaagttgaggaccttgtcgctcatttggcagaaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtctataaacctgcttgacgtcttgcacatcagactacttgttggatctcagattgcagcagagatgcgggaagccatgtataatcagttggggctcactggctgtgctggagtggcttctaataaactgttggcaaaattagtttctggtgtctttaaaccaaatcaacaaacagtcttattacctgaaagttgtcaacatcttattcatagtttgaatcacataaaggaaatacctggtattggctataaaactgccaaatgtcttgaagcactgggtatcaatagtgtgcgtgatctccaaaccttttcacccaaaattttagaaaaagaattaggaatttcagttgctcagcgtatccaaaagctcagttttggagaggataactcccctgtgatactctcaggaccacctcagtcctttagtgaagaagattcatttaaaaaatgttcatctgaagttgaagctaaaaataagattgaagaactacttgctagtcttttaaacagagtatgccaagatggaaggaagcctcatacagtgagattaataatccgtcggtattcctctgagaagcactatggtcgtgagagtcgtcagtgccctattccttcacatgtaattcagaaattagggacaggaaattatgatgtgatgaccccaatggttgatatacttatgaaactttttcgaaatatggtgaatgtgaagatgccatttcaccttacccttctaagtgtgtgcttctgcaaccttaaagcactaaatactgctaagaaagggcttattgattattatttaatgccatcattatcaactacttcacgctctggcaagcacagttttaaaatgaaagacactcatatggaagattttcccaaagacaaagaaacaaaccgggatttcctaccaagtggaagaattgaaagtacaagaactagggagtctccactagataccacaaatttttctaaagaaaaagacattaatgaattcccactctgttcacttcctgaaggtgttgaccaagaagtcttcaagcagcttccagtagatattcaagaagaaatcctttctggaaaatctagggaaaaatttcaagggaaaggaagtgtgagttgtccattacatgcctctagaggagtattatctttcttttctaaaaaacaaatgcaagatattcccataaatcctagagatcatttatccagtagcaaacaggtatcctctgtatctccttgtgaaccgggaacatcaggctttaatagcagtagttcttcttacatgtctagccaaaaggattattcatattatttagataatagattaaaagatgaacgaataagtcaaggacctaaagaacctcaaggattccactttacaaattcaaaccctgctgtgtctgcttttcattcatttccaaacttgcagagtgagcaacttttctccagaaaccacactacagatagccataagcaaacagtagcaacagactctcatgaaggacttacagaaaatagagagccagattctgttgatgagaaaattactttcccttctgacattgatcctcaagttttctatgaactaccagaagcagtacaaaaggaactgctggcagagtggaagagagcaggatcagatttccacattggacataaataagcatattcagcaaaaaggtctgaaaagcaagggaataccattattttcggattagcggtttattaagctcttctatattaaacactaatagatattcaataacggagtaaactgttccagataaagcaagaatagttgcaagaagtaaattctggcacaaagcgtaaaaatataacagaagaaataatgtaaaatactatcttttatgtctaaagccattttatattacttttcaataaaaagaatatcatggtcaa

SEQ ID NO: 167336 - DNA, 654 bp, Homo sapiens
  Payload ID: 12924
  Gene Symbol: POLI
  Gene Name: polymerase (DNA directed) iota
  ENST ID: ENST00000579823
  CDS Start-End: 1-428
tttcacccaaaattttagaaaaagaattaggaatttcagttgctcagcgtatccaaaagctcagttttggagaggataactcccctgtgatactctcaggaccacctcagtcctttagtgaagaagattcatttaaaaaatgttcatctgaagttgaagctaaaaataagattgaagaactacttgctagtcttttaaacagagtatgccaagatggaaggaagcctcatacagtgagattaataatccgtcggtattcctctgagaagcactatggtcgtgagagtcgtcagtgccctattccttcacatgtaattcagaaattagggacaggtctccagtccccagatttctgtgcatcctctctcatgcaaagaaggctggaagacaaacttgtgaagctagagggtgtttttactaaacactaaaggagttttactaaaggagtttcaaattcatgtgaccacgccacagtcaacacacagaacaggtttatcacaaggatccctcctgccaccctttcaaagcgaaagccactttctttctgctcctcccccacctccctaaccccagaaaccactaattctgttcatctttatcattttgtcatttcaaaaatgttaaataaatggaagaatccactatttaacctta

SEQ ID NO: 167337 - DNA, 1204 bp, Homo sapiens
  Payload ID: 12924
  Gene Symbol: POLI
  Gene Name: polymerase (DNA directed) iota
  ENST ID: ENST00000583136
  CDS Start-End: 538-1204
cggcgacgacgacgaggaagacgccgaggcctgggccatggaactggcggacgtgggggcggcagccagctcgcagggtgcgccgcagccagaggagccagcggcctccttgggtgtaaatgagaagggtggggcaggcggacgctcggggcggcggccactggggcgcgaccgtccccgccccactcggctcctctaagagagggctgcctccctctgccttgtgttacgcggcgggtacctctagaggaatggcttcacccagcaggagtagggtggggcgcgtccacactacaaatacgtgtcgagggtttatctgcgccgtcctttcctctgtgaggggcgaggtggggcgggaatccctcagccagcccgacgaaaactgcagaggcttctgggccttttaactttggagaagttgaggaccttgtcgctcatttggcagaaggagttcatgatcaagtgttgcccacaccaaatgcttcatccagagtcatagtacatgtggatctggattgcttttatgcacaagtagaaatgatctcaaatccagagctaaaagacaaacctttaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtctataaacctgcttgacgtcttgcacatcagactacttgttggatctcagattgcagcagagatgcgggaagccatgtataatcagttggggctcactggctgtgctggagtggcttctaataaactgttggcaaaattagtttctggtgtctttaaaccaaatcaacaaacagtcttattacctgaaagttgtcaacatcttattcatagtttgaatcacataaaggaaatacctggtattggctataaaactgccaaatgtcttgaagcactgggtatcaatagtgtgcgtgatctccaaaccttttcac

SEQ ID NO: 167338 - DNA, 1734 bp, Homo sapiens
  Payload ID: 12924
  Gene Symbol: POLI
  Gene Name: polymerase (DNA directed) iota
  ENST ID: ENST00000585023
  CDS Start-End: 1-159
tgtcttgaagcactgggtatcaatagtgtgcgtgatctccaaaccttttcacccaaaattttagaaaaagaattaggaatttcagttgctcagcgtatccaaaagctcagttttggagaggataactcccctgtgatactctcaggaccacctcagtgagtacaatagcttgcagataaaaaactgttaatataaaagtgaactaaatggctcaaactaaggacaagagtcctttagtgaagaagattcatttaaaaaatgttcatctgaagttgaagctaaaaataagattgaagaactacttgctagtcttttaaacagagtatgccaagatggaaggaagcctcatacagtgagattaataatccgtcggtattcctctgagaagcactatggtcgtgagagtcgtcagtgccctattccttcacatgtaattcagaaattagggacaggaaattatgatgtgatgaccccaatggttgatatacttatgaaactttttcgaaatatggtgaatgtgaagatgccatttcaccttacccttctaagtgtgtgcttctgcaaccttaaagcactaaatactgctaagaaagggcttattgattattatttaatgccatcattatcaactacttcacgctctggcaagcacagttttaaaatgaaagacactcatatggaagattttcccaaagacaaagaaacaaaccgggatttcctaccaagtggaagaattgaaagtacaagaactagggagtctccactagataccacaaatttttctaaagaaaaagacattaatgaattcccactctgttcacttcctgaaggtgttgaccaagaagtcttcaagcagcttccagtagatattcaagaagaaatcctttctggaaaatctagggaaaaatttcaagggaaaggaagtgtgagttgtccattacatgcctctagaggagtattatctttcttttctaaaaaacaaatgcaagatattcccataaatcctagagatcatttatccagtagcaaacaggtatcctctgtatctccttgtgaaccgggaacatcaggctttaatagcagtagttcttcttacatgtctagccaaaaggattattcatattatttagataatagattaaaagatgaacgaataagtcaaggacctaaagaacctcaaggattccactttacaaattcaaaccctgctgtgtctgcttttcattcatttccaaacttgcagagtgagcaacttttctccagaaaccacactacagatagccataagcaaacagtagcaacagactctcatgaaggacttacagaaaatagagagccagattctgttgatgagaaaattactttcccttctgacattgatcctcaagttttctatgaactaccagaagcagtacaaaaggaactgctggcagagtggaagagagcaggatcagatttccacattggacataaataagcatattcagcaaaaaggtctgaaaagcaagggaataccattattttcggattagcggtttattaagctcttctatattaaacactaatagatattcaataacggagtaaactgttccagataaagcaagaatagttgcaagaagtaaattctggcacaaagcgtaaaaatataacagaagaaataatgtaaaatactatcttttatgtctaaagccattttatattacttttcaataaaaagaatatcatggtcaa

SEQ ID NO: 167339 - DNA, 585 bp, Homo sapiens
  Payload ID: 12924
  Gene Symbol: POLI
  Gene Name: polymerase (DNA directed) iota
  ENST ID: ENST00000577612
  CDS Start-End: 1-585
agaagctgggggtggagccggaggaggaaggcggcggcgacgacgacgaggaagacgccgaggcctgggccatggaactggcggacgtgggggcggcagccagctcgcagggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtctataaacctgcttgacgtcttgcacatcagactacttgttggatctcagattgcagcagagatgcgggaagccatgtataatcagttggggctcactggctgtgctggagtggcttctaataaactgttggcaaaattagtttctggtgtcttta

SEQ ID NO: 167340 - DNA, 5911 bp, Homo sapiens
  Payload ID: 12925
  Gene Symbol: POLK
  Gene Name: polymerase (DNA directed) kappa
  Uniprot ID: Q9UBT6
  ENST ID: ENST00000241436
  CDS Start-End: 173-2785
tacctccggctctcccgggtgacgacgggtagaaaagcaggaggagcggagaaaggagagggcggggtagggatgcagctgtgctgcattctgggaagggcgttggtccgtcgctcgcgcagcctcctgggagttgtagtcgcgatcctgaggtaacggataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatacatatactgattctgtgtatcttttttataaccatgagaattttacttccattatacatcaattggaaatcaatcctgttaagagataattcttaaaagggaaattaggaatgggataagaaggtgatttttttattatttttatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggttttcttcaggaaaataaatatcacagtattatctgtgttaaaatggtttttgcctaaaatataatttttaatttggcttttcttatttaaaattccattatcttatgaataagcacttgaatcagtttttaaaatatttagtctaagatgattcaaagtagttttattttaatacaggacttttaaatggcagtatttcatttcttgtcaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaatagtagttagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctactaaaacgataaaaaaaaaaaaaaaattagccaggcttggtggcacacgcctgtaatcccagctactcagatggctgaggcaggagaactacttgaacctgggaggtcaaagctgcagtcagccaagatcttgccactgtactccagcctgaagagcgagactctgtctcaataatataataatagttattatttaattgcaacatgaagttggaagccattttctgttacttctttaaggagctaaatcttttatatttttgttttctctccccttgcgtttcatattttagcttatgatctaaatatatattttgtatattataatattttaggaatagcttaattaagaactcacagactttgacaaagtggtaactagacttttaattactagattcttcaaattaggcttaatgcctgctagcatgccaatccaatcccatgactgatgttattatacactatggcaaatacaaagttgtagtattatggttcttgatggtgtgatttacttatgtaaattatgtacaaatttaagttcaatgaaacactgatttaatgtactgaaaggtaaatagtaccatagtgaattattttctgtcttgccttaggtttatttttattatcttcaatattagaataaatgctaaattattttcatttaaggatttatgtagttgaatattatcatttagtaatatttaatcatttgaaataaaatttaaagctttaattgatctaatagagatggttttctacttttccactcttcctccctcttatgccttcacttttgttttctgtgcccagaattttcttcacattctttactacctgttttgtctattatatccaacccattttctttttattataattttgatttggggcatttgaagaaaatacagcaaaactacaagaactggtaataagcatgcataatctcacctacttagtgaacctaatataaacctaatataaagaaccaccgtatttgcaatatatataactggtgaaaaactagtgtccagaatatataaatgatccctatgaatcagtaagaaaaagacagtcaatagaaatttggacaaaagactttatatggcatttcaagtgaaaggaaatccagatgaccaagaaacatgaaaatattcccagccatattaatatttgagaagtaaaaaataaaactacaaggaggtattacatctttaccttatttgcaaaaatgaaatgatctaatgatactaagttttggtgatgatgtcagctcttacattgaaaacaatcactgtggaaaaatttgtccctcagtaaatttaaagataaacatgctcaaaacctagcaattgcactctgaagtatacatctttgcaggttatctttcattacagttatttttttccctgtcaggaccctaactaatacaatgccttgggaaaactaatgaacatgtatcctaggaagcatgtacaagaaagttcttcccagtcaggaaggtggccaagaaaaaaattttttaatgttcatagcagcactgcaatatccaaaagttagaaatgaaccaaatattcagcaatggtagaatggttaaattgtaccatggcatttatattgaaacagtagaattctacacagtggtgaaaatgaaggaaatagctaaccacaacatagatgaatatcacagacatagcatagagcaaaagaagcaaatcacagaaggatgccatcaacatgattccatttgtataaagtttaaaacagtataaactgaacaactatattgttttaagggtatatagttatatatatgagatacaactgtaaagaaaagcaagtgttttgctgtccccagaaccagaataatgatttcctctgtggagaagtacagcagtgtgattggggagtggcacctggtgcttctgggatgctggcaatgttctatttcttgtcttgggtggtgattgcatggatgttcacttttaaaatactctttatacatatatattttatatattcttgttcatatataacctttataataaagagaaaaaaatggcaaaaa

SEQ ID NO: 167341 - DNA, 1594 bp, Homo sapiens
  Payload ID: 12925
  Gene Symbol: POLK
  Gene Name: polymerase (DNA directed) kappa
  ENST ID: ENST00000511527
  CDS Start-End: 1-273
atggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacagattaacatcaaattttaacattataaaagcaattctacagaggaacatttacattatgctacagtatcttcagttgtaccttcctgttcagcataaacatcatatgccaaagaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaaggtagctcaagtggagtacagaaggctgtaacaagaacaaaaaggccaggattgatgacaaagtactcaacatcaaagaaaataaaaccaaacaatcccaaacatacccttgatatattttttaa

SEQ ID NO: 167342 - DNA, 565 bp, Homo sapiens
  Payload ID: 12925
  Gene Symbol: POLK
  Gene Name: polymerase (DNA directed) kappa
  ENST ID: ENST00000505774
  CDS Start-End: 167-439
gacgtgagagagctttccgctgaagatgacgggcctgctttccagggcggcttgtcgaaagcccgggagcatctggccgcttccgcctcaaccatgggctggggttttgtgagctactagtgccaagggttttctttccaccagaccaccgctataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacagattaacatcaaattttaacattataaaagcaattctacagaggaacatttacattatgctacagtatcttcagttgtaccttcctgttcagcataaacatcatatgccaaagaggttgacagatttgcaatggaattagaacaa

SEQ ID NO: 167343 - DNA, 2482 bp, Homo sapiens
  Payload ID: 12925
  Gene Symbol: POLK
  Gene Name: polymerase (DNA directed) kappa
  ENST ID: ENST00000503479
  CDS Start-End: 134-1324
tctgggaagggcgttggtccgtcgctcgcgcagcctcctgggagttgtagtcgcgatcctgaggtaacgggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaagaagaaatatttgccattgctaaggaattgctaaaaacagaaattgatgctgattttccacatcccttgagattaaggcttatgggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaaacattgaacattttatcattaa

SEQ ID NO: 167344 - DNA, 2677 bp, Homo sapiens
  Payload ID: 12925
  Gene Symbol: POLK
  Gene Name: polymerase (DNA directed) kappa
  Uniprot ID: Q9UBT6
  ENST ID: ENST00000510815
  CDS Start-End: 274-1392
gtagtcgcgatcctgaggtaacgggggtccagattttatggaaatgagctcaagaaagaaaagcaagtcaaccaacgaattgaaaatatgatgcaacaaaaagctcaaatcaccagccaacagctaagaaaagcacaattacagattaacatcaaattttaacattataaaagcaattctacagaggaacatttacattatgctacagtatcttcagttgtaccttcctgttcagcataaacatcatatgccaaagaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaagaagaaatatttgccattgctaaggaattgctaaaaacagaaattgatgctgattttccacatcccttgagattaaggcttatgggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatac

SEQ ID NO: 167345 - DNA, 4345 bp, Homo sapiens
  Payload ID: 12925
  Gene Symbol: POLK
  Gene Name: polymerase (DNA directed) kappa
  ENST ID: ENST00000514141
  CDS Start-End: 14-1297
ataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatacatatactgattctgtgtatcttttttataaccatgagaattttacttccattatacatcaattggaaatcaatcctgttaagagataattcttaaaagggaaattaggaatgggataagaaggtgatttttttattatttttatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggttttcttcaggaaaataaatatcacagtattatctgtgttaaaatggtttttgcctaaaatataatttttaatttggcttttcttatttaaaattccattatcttatgaataagcacttgaatcagtttttaaaatatttagtctaagatgattcaaagtagttttattttaatacaggacttttaaatggcagtatttcatttcttgtcaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaatagtagttagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctactaaaacgataaaaaaaaaaaaaaaattagccaggcttggtggcacacgcctgtaatcccagctactcagatggctgaggcaggagaactacttgaacctgggaggtcaaagctgcagtcagccaagatcttgccactgtactccagcctgaagagcgagactctgtctcaataatataataatagttattatttaattgcaacatgaagttggaagccattttctgttacttctttaaggagctaaatcttttatatttttgttttctctccccttgcgtttcatattttagcttatgatctaaatatatattttgtatattataatattttaggaatagcttaattaagaactcacagactttgacaaagtggtaactagacttttaattactagattcttcaaattaggcttaatgcctgctagcatgccaatccaatcccatgactgatgttattatacactatggcaaatacaaagttgtagtattatggttcttgatggtgtgatttacttatgtaaattatgtacaaatttaagttcaatgaaacactgatttaatgtactgaaaggtaaatagtaccatagtgaattattttctgtcttgccttaggtttatttttattatcttcaatattagaataaatgctaaattattttcatttaaggatttatgtagttgaatattatcatttagtaatatttaatcatttgaaataaaatttaaagctttaattgatctaatagagatggtttt

SEQ ID NO: 167346 - DNA, 2441 bp, Homo sapiens
  Payload ID: 12925
  Gene Symbol: POLK
  Gene Name: polymerase (DNA directed) kappa
  Uniprot ID: Q9UBT6
  ENST ID: ENST00000509126
  CDS Start-End: 1-1470
atggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaaggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaa

SEQ ID NO: 167347 - DNA, 1438 bp, Homo sapiens
  Payload ID: 12925
  Gene Symbol: POLK
  Gene Name: polymerase (DNA directed) kappa
  Uniprot ID: Q9UBT6
  ENST ID: ENST00000515295
  CDS Start-End: 14-1432
ataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaaggtgctttattttgatatggtgtccttagtttttaagttttttaatagtaaaatgctaccttaaaagcta

SEQ ID NO: 167348 - DNA, 2727 bp, Homo sapiens
  Payload ID: 12925
  Gene Symbol: POLK
  Gene Name: polymerase (DNA directed) kappa
  ENST ID: ENST00000505975
  CDS Start-End: 1-273
atggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacagattaacatcaaattttaacattataaaagcaattctacagaggaacatttacattatgctacagtatcttcagttgtaccttcctgttcagcataaacatcatatgccaaagaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaa

SEQ ID NO: 167349 - DNA, 1484 bp, Homo sapiens
  Payload ID: 12925
  Gene Symbol: POLK
  Gene Name: polymerase (DNA directed) kappa
  Uniprot ID: Q9UBT6
  ENST ID: ENST00000504026
  CDS Start-End: 1-1386
atggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaaggtagctcaagtggagtacagaaggctgtaacaagaacaaaaaggccaggattgatgacaaagtactcaacatcaaagaaaataaaaccaaacaatcccaaacatacccttgatatattttttaagtaa

SEQ ID NO: 167350 - DNA, 1536 bp, Homo sapiens
  Payload ID: 12925
  Gene Symbol: POLK
  Gene Name: polymerase (DNA directed) kappa
  ENST ID: ENST00000514296
  CDS Start-End: 1029-1452
tgagagagctttccgctgaagatgacgggcctgctttccagggcggcttgtcgaaagcccgggagcatctggccgcttccgcctcaaccatgggctggggttttgtgagctactagtgccaagggttttctttccaccagaccaccgctgtaaatctcgagggtcttactcattagaagttagaattcacatttgacgtttaaaggaagaatttccttagtaccttctcacaagcacgcacttcgcatttttagatttctagagtttgctttgtagaaagtaattttgaggttgtcagagaataaatgacgttagaaaggtttttaaagtaaaacaagaatgtgagatgatagcctgggattttctcttggttgtaaatgaatatcttactgagaaccacgttaaccatgcctgcccctcaaagataggaaaggttggatatatagaaactttctcgtattagaaataccgaagtgcagtggttttgtgtgtacaagggattaggcaataggaggctatttttgttttaagactagggttgaattagcagaaagaccaatagaagatctaacaactcttgtcagttgtcaaggataactttgattatgagactttgactttgtagcttcagtaatttcctctcgttagctattttaatatagtcgatttccttgtaattgccaagagtaaaatttgttattaaaccttagaaagagtactttcttactacaaggatgggacgataggagcgaaatttcgagtctaagggaaaacgctggccgagtgtggtggctcacgcctgtaatcccagcacttcgggaggccgaggtgggtggatcacctgaggccgggagtttgagaccagcctgggcaacaagatttttcttcatccctttactttgagtctgtggatgtcattgcatgtgatatgggtctcctgaagacagcataccattggattttgcttctttatccaagttatcattctgtcttttaattggggtgtgcattcaagataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgcccccca

SEQ ID NO: 167351 - DNA, 2019 bp, Homo sapiens
  Payload ID: 12925
  Gene Symbol: POLK
  Gene Name: polymerase (DNA directed) kappa
  Uniprot ID: Q9UBT6
  ENST ID: ENST00000508526
  CDS Start-End: 1-2019
atggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaa

SEQ ID NO: 167352 - DNA, 2899 bp, Homo sapiens
  Payload ID: 12926
  Gene Symbol: POLN
  Gene Name: polymerase (DNA directed) nu
  Uniprot ID: Q7Z5Q5
  ENST ID: ENST00000382865
  CDS Start-End: 1-2703
atggaaaattatgaggcattggtaggctttgatctctgtaatacaccgctctccagtgttgctcagaagattatgtctgctatgcattcaggtgatttagtggattctaagacttggggaaagagtacagagactatggaagtgataaacaagtccagtgttaagtattcagtacaacttgaagacaggaagactcaatcaccagaaaaaaaggatcttaaatctttaagaagtcagacatcaagaggttctgccaagctgtctcctcagtccttcagtgtcaggctcacagatcagctgtctgctgaccaaaaacagaagagcatcagctcattgactctttcaagttgtttaattccacagtataatcaagaggcttcagttctacagaaaaaggggcataaaagaaagcatttcctaatggagaatataaataatgaaaataaaggaagcattaatcttaaaagaaaacatattacatataataatttgtcagagaaaacaagtaaacaaatggcattggaagaagatactgatgacgccgaaggctacctaaattctgggaactcaggagcattgaaaaaacatttttgtgatattaggcatttggatgattgggcaaaaagccagctgattgaaatgctcaaacaggcagcagccctggtgataactgtgatgtatactgatggttccacccagctaggagctgaccagacccccgtttcttctgttagaggaattgtggtgttagtaaaacgccaagcagagggtggccatggctgtccagatgccccggcctgtggtcctgttctggagggctttgtgtcagatgatccatgcatctacattcaaatagagcactctgctatctgggaccaagaacaggaggcacatcaacaatttgcccggaacgtgctatttcaaacaatgaaatgtaaatgtcctgttatttgttttaatgctaaggattttgtgagaatagtgctgcagttttttggcaatgatggcagttggaagcatgttgctgattttatagggctagatcccagaattgctgcatggcttatagatcctagtgatgccacaccctcttttgaagatttagtagaaaaatactgtgaaaaatccattacagttaaagtgaacagcacatatggaaattcctcaagaaatattgtgaatcagaatgtacgtgagaacctgaagacactctacagacttacaatggacctttgctctaaactgaaggattatggtttatggcaactatttcgtactttggagcttcctctgataccaattttggcagtgatggaaagccatgccattcaggtgaacaaagaggagatggagaagacgtcagcacttcttggggctcgtctcaaggaattggagcaagaagctcattttgttgcaggagaacggtttcttataacgagcaataaccagcttcgagagatcctctttggcaagttaaagctgcacctgctgagtcaaaggaacagtctccccagaacggggttgcagaaatacccgtctacatcagaagcagtgttaaatgctctgcgagaccttcatccattacccaagataattttggaatacaggcaggttcacaagatcaagtcaacctttgtagatggattactagcttgcatgaaaaagggctccatttcctctacatggaatcagactggaactgtgactggaagactttcagccaagcatcctaatatccaaggtatctccaagcacccaattcagattactacacctaagaattttaaaggtaaagaagacaagattctcacgatctccccgagggccatgtttgtttcatccaaaggccacacctttctagcagcagacttttcacagattgaattgcgcattcttacacatttatctggagatccggaacttctgaagttattccaggaatctgaaagagatgatgtattttctactctgacttcacagtggaaggatgtgcccgtggaacaggtgacacacgcagacagagagcaaaccaagaaggtggtgtacgcggtggtctatggagcagggaaggagcggctggctgcttgccttggagttcctattcaggaagctgcccagtttttggagagttttttgcagaagtacaagaaaatcaaggacttcgcccgagcagctattgcccagtgtcaccagacaggctgtgtggtgtccatcatgggcagaaggagacccctgccaaggattcacgctcatgaccagcaactccgggcacaagcagagcgacaggcagtgaacttcgtggtgcaaggctccgctgctgacctctgcaagctggccatgatccatgtcttcactgcagtggctgcttcccacaccttgacggccaggctggtggcccagatccatgatgagctgctgtttgaagtggaagatccgcagatcccggagtgtgcagctctcgtcaggaggaccatggagtccttggaacaggtgcaggcattggagctgcagcttcaggtacccctcaaggtgagcctgagtgccggccgctcatggggacacctggtgccactgcaggaggcctggggccctccgccaggcccatgtcgcactgagtctcccagcaacagcctggctgcccctgggtcccctgccagcacccagcccccacccctgcatttttcgccttcattttgtctgtagccccaggcaacagtgggaggagagaactggtttccagcagtccattgtgtggccttccccaaggtcaccagctctgtacgccccaggacgcattaaccctttggggctggggtggcccgccatcccctggagtaaatgcctgtgcaaagccctcctcatccttgtctgagtgaattcttcctgtgagtgggaagtg

SEQ ID NO: 167353 - DNA, 1738 bp, Homo sapiens
  Payload ID: 12926
  Gene Symbol: POLN
  Gene Name: polymerase (DNA directed) nu
  ENST ID: ENST00000511098
  CDS Start-End: 1-1574
atttagtagaaaaatactgtgaaaaatccattacagttaaagtgaacagcacatatggaaattcctcaagaaatattgtgaatcagaatgtacgtgagaacctgaagacactctacagacttacaatggacctttgctctaaactgaaggattatggtttatggcaactatttcgtactttggagcttcctctgataccaattttggcagtgatggaaagccatgccattcaggtgaacaaagaggagatggagaagacgtcagcacttcttggggctcgtctcaaggaattggagcaagaagctcattttgttgcaggagaacggtttcttataacgagcaataaccagcttcgagagatcctctttggcaagttaaagctgcacctgctgagtcaaaggaacagtctccccagaacggggttgcagaaatacccgtctacatcagaagcattaaatgctctgcgagaccttcatccattacccaagataattttggaatacaggcaggttcacaagatcaagtcaacctttgtagatggattactagcttgcatgaaaaagggctccatttcctctacatggaatcagactggaactgtgactggaagactttcagccaagcatcctaatatccaaggtatctccaagcacccaattcagattactacacctaagaattttaaaggtaaagaagacaagattctcacgatctccccgagggccatgtttgtttcatccaaaggccacacctttctagcagcagacttttcacagattgaattgcgcattcttacacatttatctggagatccggaacttctgaagttattccaggaatctgaaagagatgatgtattttctactctgacttcacagtggaaggatgtgcccgtggaacaggtgacacacgcagacagagagcaaaccaagaaggtggtgtacgcggtggtctatggagcagggaaggagcggctggctgcttgccttggagttcctattcaggaagctgcccagtttttggagagttttttgcagaagtacaagaaaatcaaggacttcgcccgagcagctattgcccagtgtcaccagacaggctgtgtggtgtccatcatgggcagaaggagacccctgccaaggattcacgctcatgaccagcaactccgggcacaagcagagcgacaggcagtgaacttcgtggtgcaaggctccgctgctgacctctgcaagctggccatgatccatgtcttcactgcagtggctgcttcccacaccttgacggccaggctggtggcccagatccatgatgagctgctgtttgaagtggaagatccgcagatcccggagtgtgcagctctcgtcaggaggaccatggagtccttggaacaggtacccctcaaggtgagcctgagtgccggccgctcatggggacacctggtgccactgcaggaggcctggggccctccgccaggcccatgtcgcactgagtctcccagcaacagcctggctgcccctgggtcccctgccagcacccagcccccacccctgcatttttcgccttcattttgtctgtagccccaggcaacagtgggaggagagaactggtttccagcagtccattgtgtggccttccccaaggtcaccagctctgtacgccccaggacgcattaaccctttggggctggggtggcccgccatcccctggagtaaatgcctgtgcaaagccctcctcatccttg

SEQ ID NO: 167354 - DNA, 3253 bp, Homo sapiens
  Payload ID: 12926
  Gene Symbol: POLN
  Gene Name: polymerase (DNA directed) nu
  Uniprot ID: Q7Z5Q5
  ENST ID: ENST00000511885
  CDS Start-End: 355-3057
agtgcgaggcgcgcggggcacggagggcggtggcggcgggctcctgcgagaagcaagcggaacttcctgagcgtgcttaggtgtcacagctgggtgaccctccgaaggaaggttttgccgctggcgcgtctggtgtatcgcggccttggggccgcggatccctggggcttgccgctgcctctggggttcgcgcggccctggcgtcggggctgcctcagcgctggctgaaggccggcccgaagcacccttaattgtggccgcgcgcttccctgctgctcctgctgttctccgcgtcgcggtggtggactctggaggtggagccttgcccggcgagacgttgaggattttgtgaaaatggaaaattatgaggcattggtaggctttgatctctgtaatacaccgctctccagtgttgctcagaagattatgtctgctatgcattcaggtgatttagtggattctaagacttggggaaagagtacagagactatggaagtgataaacaagtccagtgttaagtattcagtacaacttgaagacaggaagactcaatcaccagaaaaaaaggatcttaaatctttaagaagtcagacatcaagaggttctgccaagctgtctcctcagtccttcagtgtcaggctcacagatcagctgtctgctgaccaaaaacagaagagcatcagctcattgactctttcaagttgtttaattccacagtataatcaagaggcttcagttctacagaaaaaggggcataaaagaaagcatttcctaatggagaatataaataatgaaaataaaggaagcattaatcttaaaagaaaacatattacatataataatttgtcagagaaaacaagtaaacaaatggcattggaagaagatactgatgacgccgaaggctacctaaattctgggaactcaggagcattgaaaaaacatttttgtgatattaggcatttggatgattgggcaaaaagccagctgattgaaatgctcaaacaggcagcagccctggtgataactgtgatgtatactgatggttccacccagctaggagctgaccagacccccgtttcttctgttagaggaattgtggtgttagtaaaacgccaagcagagggtggccatggctgtccagatgccccggcctgtggtcctgttctggagggctttgtgtcagatgatccatgcatctacattcaaatagagcactctgctatctgggaccaagaacaggaggcacatcaacaatttgcccggaacgtgctatttcaaacaatgaaatgtaaatgtcctgttatttgttttaatgctaaggattttgtgagaatagtgctgcagttttttggcaatgatggcagttggaagcatgttgctgattttatagggctagatcccagaattgctgcatggcttatagatcctagtgatgccacaccctcttttgaagatttagtagaaaaatactgtgaaaaatccattacagttaaagtgaacagcacatatggaaattcctcaagaaatattgtgaatcagaatgtacgtgagaacctgaagacactctacagacttacaatggacctttgctctaaactgaaggattatggtttatggcaactatttcgtactttggagcttcctctgataccaattttggcagtgatggaaagccatgccattcaggtgaacaaagaggagatggagaagacgtcagcacttcttggggctcgtctcaaggaattggagcaagaagctcattttgttgcaggagaacggtttcttataacgagcaataaccagcttcgagagatcctctttggcaagttaaagctgcacctgctgagtcaaaggaacagtctccccagaacggggttgcagaaatacccgtctacatcagaagcagtgttaaatgctctgcgagaccttcatccattacccaagataattttggaatacaggcaggttcacaagatcaagtcaacctttgtagatggattactagcttgcatgaaaaagggctccatttcctctacatggaatcagactggaactgtgactggaagactttcagccaagcatcctaatatccaaggtatctccaagcacccaattcagattactacacctaagaattttaaaggtaaagaagacaagattctcacgatctccccgagggccatgtttgtttcatccaaaggccacacctttctagcagcagacttttcacagattgaattgcgcattcttacacatttatctggagatccggaacttctgaagttattccaggaatctgaaagagatgatgtattttctactctgacttcacagtggaaggatgtgcccgtggaacaggtgacacacgcagacagagagcaaaccaagaaggtggtgtacgcggtggtctatggagcagggaaggagcggctggctgcttgccttggagttcctattcaggaagctgcccagtttttggagagttttttgcagaagtacaagaaaatcaaggacttcgcccgagcagctattgcccagtgtcaccagacaggctgtgtggtgtccatcatgggcagaaggagacccctgccaaggattcacgctcatgaccagcaactccgggcacaagcagagcgacaggcagtgaacttcgtggtgcaaggctccgctgctgacctctgcaagctggccatgatccatgtcttcactgcagtggctgcttcccacaccttgacggccaggctggtggcccagatccatgatgagctgctgtttgaagtggaagatccgcagatcccggagtgtgcagctctcgtcaggaggaccatggagtccttggaacaggtgcaggcattggagctgcagcttcaggtacccctcaaggtgagcctgagtgccggccgctcatggggacacctggtgccactgcaggaggcctggggccctccgccaggcccatgtcgcactgagtctcccagcaacagcctggctgcccctgggtcccctgccagcacccagcccccacccctgcatttttcgccttcattttgtctgtagccccaggcaacagtgggaggagagaactggtttccagcagtccattgtgtggccttccccaaggtcaccagctctgtacgccccaggacgcattaaccctttggggctggggtggcccgccatcccctggagtaaatgcctgtgcaaagccctcctcatccttgtctgagtgaattcttcctgtgagtgggaagtg

SEQ ID NO: 167355 - DNA, 5440 bp, Homo sapiens
  Payload ID: 12927
  Gene Symbol: POLA1
  Gene Name: polymerase (DNA directed), alpha 1, catalytic subunit
  Uniprot ID: P09884
  ENST ID: ENST00000379059
  CDS Start-End: 16-4404
gggagattcgggaccatggcacctgtgcacggcgacgactctctgtcagattcagggagttttgtatcttctcgagcccggcgagaaaaaaaatcaaagaaggggcgccaagaagccctagaaagactgaaaaaggctaaagctggtgagaagtataaatatgaagtcgaggacttcacaggtgtttatgaagaagttgatgaagaacagtattcgaagctggttcaggcacgccaggatgatgactggattgtggatgatgatggtattggctatgtggaagatggccgagagatttttgatgatgaccttgaagatgatgcccttgatgctgatgagaaaggaaaagatggtaaagcacgcaataaagacaagaggaatgtaaagaagctcgcagtgacaaaaccgaacaacattaagtcaatgttcattgcttgtgctggaaagaaaactgcagataaagctgtagacttgtccaaggatggtctgctaggtgacattctacaggatcttaacactgagacacctcaaataactccaccacctgtaatgatactgaagaagaaaagatccattggagcttcaccgaatcctttctctgtgcacaccgccacggcagttccttcaggaaaaattgcttcccctgtctccagaaaggagcctccattaactcctgttcctcttaaacgtgctgaatttgctggcgatgatgtacaggtcgagagtacagaagaagagcaggagtcaggggcaatggagtttgaagatggtgactttgatgagcccatggaagttgaagaggtggacctggagcctatggctgccaaggcttgggacaaagagagtgagccagcagaggaagtgaaacaagaggcggattctgggaaagggaccgtgtcctacttaggaagttttctcccggatgtctcttgttgggacattgatcaagaaggtgatagcagtttctcagtgcaagaagttcaagtggattccagtcacctcccattggtaaaaggggcagatgaggaacaagtattccacttttattggttggatgcttatgaggatcagtacaaccaaccaggtgtggtatttctgtttgggaaagtttggattgaatcagccgagacccatgtgagctgttgtgtcatggtgaaaaatatcgagcgaacgctttacttccttccccgtgaaatgaaaattgatctaaatacggggaaagaaacaggaactccaatttcaatgaaggatgtttatgaggaatttgatgagaaaatagcaacaaaatataaaattatgaagttcaagtctaagccagtggaaaagaactatgcttttgagatacctgatgttccagaaaaatctgagtacttggaagttaaatactcggctgaaatgccacagcttcctcaagatttgaaaggagaaactttttctcatgtatttgggaccaacacatctagcctggaactgttcttgatgaacagaaagatcaaaggaccttgttggcttgaagtaaaaagtccacagctcttgaatcagccagtcagttggtgtaaagttgaggcaatggctttgaaaccagacctggtgaatgtaattaaggatgtcagtccaccaccgcttgtcgtgatggctttcagcatgaagacaatgcagaatgcaaagaaccatcaaaatgagattattgctatggcagctttggtccatcacagttttgcattggataaagcagccccaaagcctccctttcagtcacacttctgtgttgtgtctaaaccaaaggactgtatttttccatatgctttcaaagaagtcattgagaaaaagaatgtgaaggttgaggttgctgcaacagaaagaacactgctaggttttttccttgcaaaagttcacaaaattgatcctgatatcattgtgggtcataatatttatgggtttgaactggaagtactactgcagagaattaatgtgtgcaaagctcctcactggtccaagataggtcgactgaagcgatccaacatgccaaagcttgggggccggagtggatttggtgaaagaaatgctacctgtggtcgaatgatctgtgatgtggaaatttcagcaaaggaattgattcgttgtaaaagctaccatctgtctgaacttgttcagcagattctaaaaactgaaagggttgtaatcccaatggaaaatatacaaaatatgtacagtgaatcttctcaactgttatacctgttggaacacacctggaaagatgccaagttcattttgcagatcatgtgtgagctaaatgttcttccattagcattgcagatcactaacatcgctgggaacattatgtccaggacgctgatgggtggacgatccgagcgtaacgagttcttgttgcttcatgcattttacgaaaacaactatattgtgcctgacaagcagattttcagaaagcctcagcaaaaactgggagatgaagatgaagaaattgatggagataccaataaatacaagaaaggacgtaagaaagcagcttatgctggaggcttggttttggaccccaaagttggtttttatgataagttcattttgcttctggacttcaacagtctatatccttccatcattcaggaatttaacatttgttttacaacagtacaaagagttgcttcagaggcacagaaagttacagaggatggagaacaagaacagatccctgagttgccagatccaagcttagaaatgggcattttgcccagagagatccggaaactggtagaacggagaaaacaagtcaaacagctaatgaaacagcaagacttaaatccagaccttattcttcagtatgacattcgacagaaggctttgaagctcacagcgaacagtatgtatggttgcctgggattttcctatagcagattttacgccaaaccactggctgccttggtgacatacaaaggaagggagattttgatgcatacgaaagagatggtacaaaagatgaatcttgaagttatttatggagatacagattcaattatgataaacaccaatagcaccaatctggaagaagtatttaagttgggaaacaaggtaaaaagtgaagtgaataagttgtacaaactgcttgaaatagacattgatggggttttcaagtctctgctactgctgaaaaaaaagaagtacgctgctctggttgttgagccaacgtcggatgggaattatgtcaccaaacaggagctcaaaggattagatatagttagaagagattggtgtgatcttgctaaagacactggaaactttgtgattggccagattctttctgatcaaagccgggacactatagtggaaaacattcagaagaggctgatagaaattggagaaaatgtgctaaatggcagtgtcccagtgagccagtttgaaattaacaaggcattgacaaaggatccccaggattaccctgataaaaaaagcctacctcatgtacatgttgccctctggataaattctcaaggaggcagaaaggtgaaagctggagatactgtgtcatatgtcatctgtcaggatggatcaaacctcactgcaagtcagagggcctatgcgcctgagcagctgcagaaacaggataatctaaccattgacacccagtactacctggcccagcagatccacccagtcgtggctcggatctgtgaaccaatagacggaattgatgctgtcctcattgcaacgtggttgggacttgaccccacccaatttagagttcatcattatcataaagatgaagagaatgatgctctacttggtggcccagcacagctcactgatgaagagaaatacagggactgtgaaagattcaaatgtccatgccctacatgtggaactgagaatatttatgataatgtctttgatggttcgggaacagatatggagcccagcttgtatcgttgcagtaacatcgattgtaaggcttcacctctgacctttacagtacaactgagcaacaaattgatcatggacattagacgtttcattaaaaagtactatgatggctggttgatatgtgaagagccaacctgtcgcaatcgaactcgtcaccttccccttcaattctcccgaactgggcctctttgcccagcctgcatgaaagctacacttcaaccagagtattctgacaagtccctgtacacccagctgtgcttttaccggtacatttttgatgcggagtgtgcactggagaaacttactaccgatcatgagaaagataaattgaagaagcaattttttacccccaaagttctgcaggactacagaaaactcaagaacacagcagagcaattcttgtcccgaagtggctactccgaagtgaatctgagcaaactcttcgctggttgtgccgtgaaatcctaagggaatcccaggagtaaccaaggagggggtagttgaaaaatcccagcttcctctgtgcctccactctggccctaaatgctcctccagcatctgtttctcccttgggactgtgtctcatgtttgtgtgaatgtagaccaggaaagggggctgcaaaaatgttgagtctaatgttcgtaagcatcatagaaattcctgtcttcatattaagatgtactgctttaaaacacaactccagagcccctccccaagctcccctccccaagctcctgaagacccggtttctgagggagggaaattgctacttggattgagagtagctggaatgtaagtgaccccaggctttgcctcagggcctttagcctatgtcccccccacataaagagagcttctcagagcctgactgaagagctgacgttttgctttttcatatgccaattaaacccggtctaaatccaaatgcttctccagccatccaggagtggctgtccttttcagtcttgtcttttatataggtagctgagggggaagatttagaagccttgcactcactaaatagattaaacagagcaggcttgtttgttgaattgctccaaagtccaacagacacacactgagcaggtgttttacactcacattccctttttgccccttaaatagaaagtgcaggtaaaggtttatacaacaagaaagcacattgaaaataatttgatactctaacaatccattaacatgtgtaggggttacggtgaggatcactgtgttgtattcagaaaaacggggagagggatgcttaattggccctggcgcttgctatttttttctcatttcttcacaataggaccgtctttggcagcagcaaaatgtatttcagtatggcagtctttcctctcttacattattggtaagattatactaacaaaatgtttccccttgtacaattatgctgtgtttttaaaaaacattgacctgtgtgtttttataaaagaaaaagtatgttgtgccttcttcttaagaataaagttttctaaagggaaa

SEQ ID NO: 167356 - DNA, 5486 bp, Homo sapiens
  Payload ID: 12927
  Gene Symbol: POLA1
  Gene Name: polymerase (DNA directed), alpha 1, catalytic subunit
  ENST ID: ENST00000379068
  CDS Start-End: 44-4450
ccagttttgggctggttggcgcggaatcgggagattcgggaccatggcacctgtgcacggcgacgactgtgagataggggcgagtgctctgtcagattcagggagttttgtatcttctcgagcccggcgagaaaaaaaatcaaagaaggggcgccaagaagccctagaaagactgaaaaaggctaaagctggtgagaagtataaatatgaagtcgaggacttcacaggtgtttatgaagaagttgatgaagaacagtattcgaagctggttcaggcacgccaggatgatgactggattgtggatgatgatggtattggctatgtggaagatggccgagagatttttgatgatgaccttgaagatgatgcccttgatgctgatgagaaaggaaaagatggtaaagcacgcaataaagacaagaggaatgtaaagaagctcgcagtgacaaaaccgaacaacattaagtcaatgttcattgcttgtgctggaaagaaaactgcagataaagctgtagacttgtccaaggatggtctgctaggtgacattctacaggatcttaacactgagacacctcaaataactccaccacctgtaatgatactgaagaagaaaagatccattggagcttcaccgaatcctttctctgtgcacaccgccacggcagttccttcaggaaaaattgcttcccctgtctccagaaaggagcctccattaactcctgttcctcttaaacgtgctgaatttgctggcgatgatgtacaggtcgagagtacagaagaagagcaggagtcaggggcaatggagtttgaagatggtgactttgatgagcccatggaagttgaagaggtggacctggagcctatggctgccaaggcttgggacaaagagagtgagccagcagaggaagtgaaacaagaggcggattctgggaaagggaccgtgtcctacttaggaagttttctcccggatgtctcttgttgggacattgatcaagaaggtgatagcagtttctcagtgcaagaagttcaagtggattccagtcacctcccattggtaaaaggggcagatgaggaacaagtattccacttttattggttggatgcttatgaggatcagtacaaccaaccaggtgtggtatttctgtttgggaaagtttggattgaatcagccgagacccatgtgagctgttgtgtcatggtgaaaaatatcgagcgaacgctttacttccttccccgtgaaatgaaaattgatctaaatacggggaaagaaacaggaactccaatttcaatgaaggatgtttatgaggaatttgatgagaaaatagcaacaaaatataaaattatgaagttcaagtctaagccagtggaaaagaactatgcttttgagatacctgatgttccagaaaaatctgagtacttggaagttaaatactcggctgaaatgccacagcttcctcaagatttgaaaggagaaactttttctcatgtatttgggaccaacacatctagcctggaactgttcttgatgaacagaaagatcaaaggaccttgttggcttgaagtaaaaagtccacagctcttgaatcagccagtcagttggtgtaaagttgaggcaatggctttgaaaccagacctggtgaatgtaattaaggatgtcagtccaccaccgcttgtcgtgatggctttcagcatgaagacaatgcagaatgcaaagaaccatcaaaatgagattattgctatggcagctttggtccatcacagttttgcattggataaagcagccccaaagcctccctttcagtcacacttctgtgttgtgtctaaaccaaaggactgtatttttccatatgctttcaaagaagtcattgagaaaaagaatgtgaaggttgaggttgctgcaacagaaagaacactgctaggttttttccttgcaaaagttcacaaaattgatcctgatatcattgtgggtcataatatttatgggtttgaactggaagtactactgcagagaattaatgtgtgcaaagctcctcactggtccaagataggtcgactgaagcgatccaacatgccaaagcttgggggccggagtggatttggtgaaagaaatgctacctgtggtcgaatgatctgtgatgtggaaatttcagcaaaggaattgattcgttgtaaaagctaccatctgtctgaacttgttcagcagattctaaaaactgaaagggttgtaatcccaatggaaaatatacaaaatatgtacagtgaatcttctcaactgttatacctgttggaacacacctggaaagatgccaagttcattttgcagatcatgtgtgagctaaatgttcttccattagcattgcagatcactaacatcgctgggaacattatgtccaggacgctgatgggtggacgatccgagcgtaacgagttcttgttgcttcatgcattttacgaaaacaactatattgtgcctgacaagcagattttcagaaagcctcagcaaaaactgggagatgaagatgaagaaattgatggagataccaataaatacaagaaaggacgtaagaaagcagcttatgctggaggcttggttttggaccccaaagttggtttttatgataagttcattttgcttctggacttcaacagtctatatccttccatcattcaggaatttaacatttgttttacaacagtacaaagagttgcttcagaggcacagaaagttacagaggatggagaacaagaacagatccctgagttgccagatccaagcttagaaatgggcattttgcccagagagatccggaaactggtagaacggagaaaacaagtcaaacagctaatgaaacagcaagacttaaatccagaccttattcttcagtatgacattcgacagaaggctttgaagctcacagcgaacagtatgtatggttgcctgggattttcctatagcagattttacgccaaaccactggctgccttggtgacatacaaaggaagggagattttgatgcatacgaaagagatggtacaaaagatgaatcttgaagttatttatggagatacagattcaattatgataaacaccaatagcaccaatctggaagaagtatttaagttgggaaacaaggtaaaaagtgaagtgaataagttgtacaaactgcttgaaatagacattgatggggttttcaagtctctgctactgctgaaaaaaaagaagtacgctgctctggttgttgagccaacgtcggatgggaattatgtcaccaaacaggagctcaaaggattagatatagttagaagagattggtgtgatcttgctaaagacactggaaactttgtgattggccagattctttctgatcaaagccgggacactatagtggaaaacattcagaagaggctgatagaaattggagaaaatgtgctaaatggcagtgtcccagtgagccagtttgaaattaacaaggcattgacaaaggatccccaggattaccctgataaaaaaagcctacctcatgtacatgttgccctctggataaattctcaaggaggcagaaaggtgaaagctggagatactgtgtcatatgtcatctgtcaggatggatcaaacctcactgcaagtcagagggcctatgcgcctgagcagctgcagaaacaggataatctaaccattgacacccagtactacctggcccagcagatccacccagtcgtggctcggatctgtgaaccaatagacggaattgatgctgtcctcattgcaacgtggttgggacttgaccccacccaatttagagttcatcattatcataaagatgaagagaatgatgctctacttggtggcccagcacagctcactgatgaagagaaatacagggactgtgaaagattcaaatgtccatgccctacatgtggaactgagaatatttatgataatgtctttgatggttcgggaacagatatggagcccagcttgtatcgttgcagtaacatcgattgtaaggcttcacctctgacctttacagtacaactgagcaacaaattgatcatggacattagacgtttcattaaaaagtactatgatggctggttgatatgtgaagagccaacctgtcgcaatcgaactcgtcaccttccccttcaattctcccgaactgggcctctttgcccagcctgcatgaaagctacacttcaaccagagtattctgacaagtccctgtacacccagctgtgcttttaccggtacatttttgatgcggagtgtgcactggagaaacttactaccgatcatgagaaagataaattgaagaagcaattttttacccccaaagttctgcaggactacagaaaactcaagaacacagcagagcaattcttgtcccgaagtggctactccgaagtgaatctgagcaaactcttcgctggttgtgccgtgaaatcctaagggaatcccaggagtaaccaaggagggggtagttgaaaaatcccagcttcctctgtgcctccactctggccctaaatgctcctccagcatctgtttctcccttgggactgtgtctcatgtttgtgtgaatgtagaccaggaaagggggctgcaaaaatgttgagtctaatgttcgtaagcatcatagaaattcctgtcttcatattaagatgtactgctttaaaacacaactccagagcccctccccaagctcccctccccaagctcctgaagacccggtttctgagggagggaaattgctacttggattgagagtagctggaatgtaagtgaccccaggctttgcctcagggcctttagcctatgtcccccccacataaagagagcttctcagagcctgactgaagagctgacgttttgctttttcatatgccaattaaacccggtctaaatccaaatgcttctccagccatccaggagtggctgtccttttcagtcttgtcttttatataggtagctgagggggaagatttagaagccttgcactcactaaatagattaaacagagcaggcttgtttgttgaattgctccaaagtccaacagacacacactgagcaggtgttttacactcacattccctttttgccccttaaatagaaagtgcaggtaaaggtttatacaacaagaaagcacattgaaaataatttgatactctaacaatccattaacatgtgtaggggttacggtgaggatcactgtgttgtattcagaaaaacggggagagggatgcttaattggccctggcgcttgctatttttttctcatttcttcacaataggaccgtctttggcagcagcaaaatgtatttcagtatggcagtctttcctctcttacattattggtaagattatactaacaaaatgtttccccttgtacaattatgctgtgtttttaaaaaacattgacctgtgtgtttttataaaagaaaaagtatgttgtgccttcttcttaagaataaagttttctaaagggaaa

SEQ ID NO: 167357 - DNA, 5434 bp, Homo sapiens
  Payload ID: 12927
  Gene Symbol: POLA1
  Gene Name: polymerase (DNA directed), alpha 1, catalytic subunit
  ENST ID: ENST00000611764
  CDS Start-End: 16-4401
gggagattcgggaccatggcacctgtgcacggcgacgactctctgtcagattcagggagttttgtatcttctcgagcccggcgagaaaaaaaatcaaagaaggggcgccaagaagccctagaaagactgaaaaaggctaaagctggtgagaagtataaatatgaagtcgaggacttcacaggtgtttatgaagaagttgatgaagaacagtattcgaagctggttcaggcacgccaggatgatgactggattgtggatgatgatggtattggctatgtggaagatggccgagagatttttgatgatgaccttgaagatgatgcccttgatgctgatgagaaaggaaaagatggtaaagcacgcaataaagacaagaggaatgtaaagaagctcgcagtgacaaaaccgaacaacattaagtcaatgttcattgcttgtgctggaaagaaaactgcagataaagctgtagacttgtccaaggatggtctgctaggtgacattctacaggatcttaacactgagacacctcaaataactccaccacctgtaatgatactgaagaagaaaagatccattggagcttcaccgaatcctttctctgtgcacaccgccacggcagttccttcaggaaaaattgcttcccctgtctccagaaaggagcctccattaactcctgttcctcttaaacgtgctgaatttgctggcgatgatgtacaggtcgagagtacagaagaagagcaggagtcaggggcaatggagtttgaagatggtgactttgatgagcccatggaagttgaagaggtggacctggagcctatggctgccaaggcttgggacaaagagagtgagccagcagaggaagtgaaacaagaggcggattctgggaaagggaccgtgtcctacttaggaagttttctcccggatgtctcttgttgggacattgatcaagaaggtgatagcagtttctcagtgcaagaagttcaagtggattccagtcacctcccattggtaaaaggggcagatgaggaacaagtattccacttttattggttggatgcttatgaggatcagtacaaccaaccaggtgtggtatttctgtttgggaaagtttggattgaatcagccgagacccatgtgagctgttgtgtcatggtgaaaaatatcgagcgaacgctttacttccttccccgtgaaatgaaaattgatctaaatacggggaaagaaacaggaactccaatttcaatgaaggatgtttatgaggaatttgatgagaaaatagcaacaaaatataaaattatgaagttcaagtctaagccagtggaaaagaactatgcttttgagatacctgatgttccagaaaaatctgagtacttggaagttaaatactcggctgaaatgccacagcttcctcaagatttgaaaggagaaactttttctcatgtatttgggaccaacacatctagcctggaactgttcttgatgaacagaaagatcaaaggaccttgttggcttgaagtaaaaagtccacctcttaatcagccagtcagttggtgtaaagttgaggcaatggctttgaaaccagacctggtgaatgtaattaaggatgtcagtccaccaccgcttgtcgtgatggctttcagcatgaagacaatgcagaatgcaaagaaccatcaaaatgagattattgctatggcagctttggtccatcacagttttgcattggataaagcagccccaaagcctccctttcagtcacacttctgtgttgtgtctaaaccaaaggactgtatttttccatatgctttcaaagaagtcattgagaaaaagaatgtgaaggttgaggttgctgcaacagaaagaacactgctaggttttttccttgcaaaagttcacaaaattgatcctgatatcattgtgggtcataatatttatgggtttgaactggaagtactactgcagagaattaatgtgtgcaaagctcctcactggtccaagataggtcgactgaagcgatccaacatgccaaagcttgggggccggagtggatttggtgaaagaaatgctacctgtggtcgaatgatctgtgatgtggaaatttcagcaaaggaattgattcgttgtaaaagctaccatctgtctgaacttgttcagcagattctaaaaactgaaagggttgtaatcccaatggaaaatatacaaaatatgtacagtgaatcttctcaactgttatacctgttggaacacacctggaaagatgccaagttcattttgcagatcatgtgtgagctaaatgttcttccattagcattgcagatcactaacatcgctgggaacattatgtccaggacgctgatgggtggacgatccgagcgtaacgagttcttgttgcttcatgcattttacgaaaacaactatattgtgcctgacaagcagattttcagaaagcctcagcaaaaactgggagatgaagatgaagaaattgatggagataccaataaatacaagaaaggacgtaagaaagcagcttatgctggaggcttggttttggaccccaaagttggtttttatgataagttcattttgcttctggacttcaacagtctatatccttccatcattcaggaatttaacatttgttttacaacagtacaaagagttgcttcagaggcacagaaagttacagaggatggagaacaagaacagatccctgagttgccagatccaagcttagaaatgggcattttgcccagagagatccggaaactggtagaacggagaaaacaagtcaaacagctaatgaaacagcaagacttaaatccagaccttattcttcagtatgacattcgacagaaggctttgaagctcacagcgaacagtatgtatggttgcctgggattttcctatagcagattttacgccaaaccactggctgccttggtgacatacaaaggaagggagattttgatgcatacgaaagagatggtacaaaagatgaatcttgaagttatttatggagatacagattcaattatgataaacaccaatagcaccaatctggaagaagtatttaagttgggaaacaaggtaaaaagtgaagtgaataagttgtacaaactgcttgaaatagacattgatggggttttcaagtctctgctactgctgaaaaaaaagaagtacgctgctctggttgttgagccaacgtcggatgggaattatgtcaccaaacaggagctcaaaggattagatatagttagaagagattggtgtgatcttgctaaagacactggaaactttgtgattggccagattctttctgatcaaagccgggacactatagtggaaaacattcagaagaggctgatagaaattggagaaaatgtgctaaatggcagtgtcccagtgagccagtttgaaattaacaaggcattgacaaaggatccccaggattaccctgataaaaaaagcctacctcatgtacatgttgccctctggataaattctcaaggaggcagaaaggtgaaagctggagatactgtgtcatatgtcatctgtcaggatggatcaaacctcactgcaagtcagagggcctatgcgcctgagcagctgcagaaacaggataatctaaccattgacacccagtactacctggcccagcagatccacccagtcgtggctcggatctgtgaaccaatagacggaattgatgctgtcctcattgcaacgtggttgggacttgaccccacccaatttagagttcatcattatcataaagatgaagagaatgatgctctacttggtggcccagcacagctcactgatgaagagaaatacagggactgtgaaagattcaaatgtccatgccctacatgtggaactgagaatatttatgataatgtctttgatggttcgggaacagatatggagcccagcttgtatcgttgcagtaacatcgattgtaaggcttcacctctgacctttacagtacaactgagcaacaaattgatcatggacattagacgtttcattaaaaagtactatgatggctggttgatatgtgaagagccaacctgtcgcaatcgaactcgtcaccttccccttcaattctcccgaactgggcctctttgcccagcctgcatgaaagctacacttcaaccagagtattctgacaagtccctgtacacccagctgtgcttttaccggtacatttttgatgcggagtgtgcactggagaaacttactaccgatcatgagaaagataaattgaagaagcaattttttacccccaaagttctgcaggactacagaaaactcaagaacacagcagagcaattcttgtcccgaagtggctactccgaagtgaatctgagcaaactcttcgctggttgtgccgtgaaatcctaagggaatcccaggagtaaccaaggagggggtagttgaaaaatcccagcttcctctgtgcctccactctggccctaaatgctcctccagcatctgtttctcccttgggactgtgtctcatgtttgtgtgaatgtagaccaggaaagggggctgcaaaaatgttgagtctaatgttcgtaagcatcatagaaattcctgtcttcatattaagatgtactgctttaaaacacaactccagagcccctccccaagctcccctccccaagctcctgaagacccggtttctgagggagggaaattgctacttggattgagagtagctggaatgtaagtgaccccaggctttgcctcagggcctttagcctatgtcccccccacataaagagagcttctcagagcctgactgaagagctgacgttttgctttttcatatgccaattaaacccggtctaaatccaaatgcttctccagccatccaggagtggctgtccttttcagtcttgtcttttatataggtagctgagggggaagatttagaagccttgcactcactaaatagattaaacagagcaggcttgtttgttgaattgctccaaagtccaacagacacacactgagcaggtgttttacactcacattccctttttgccccttaaatagaaagtgcaggtaaaggtttatacaacaagaaagcacattgaaaataatttgatactctaacaatccattaacatgtgtaggggttacggtgaggatcactgtgttgtattcagaaaaacggggagagggatgcttaattggccctggcgcttgctatttttttctcatttcttcacaataggaccgtctttggcagcagcaaaatgtatttcagtatggcagtctttcctctcttacattattggtaagattatactaacaaaatgtttccccttgtacaattatgctgtgtttttaaaaaacattgacctgtgtgtttttataaaagaaaaagtatgttgtgccttcttcttaagaataaagttttctaaaggg

SEQ ID NO: 167358 - DNA, 3744 bp, Homo sapiens
  Payload ID: 12928
  Gene Symbol: POLA2
  Gene Name: polymerase (DNA directed), alpha 2, accessory subunit
  Uniprot ID: Q14181
  ENST ID: ENST00000265465
  CDS Start-End: 532-2328
gcagctgctgactggcgggccgccaggcgcgtgcgtagagacgcccacacgcccgctgatgcgcacgcgccctgggccgcgcgtgcgcgcgtggggttccggaatgagccggggaaagcaaggggaaggtttggggttggctcccggtttcgcgcatgcgtgcactgcacaaaccatttggcgggtttttccggccactcagttctgccaccgtcactgagaagctcagcggtagcttttgggaagcaggacgttctcaccaggagagcgtcctctcgagatttctgctccctccattcagggcgtttgggagccaccccttcattttttaaaaaaagtatttctctgtgaccgacggccggggccttctgacggtctgaggtcttgcttgggccagtcacctcctgtcacggtccgcggaggggggaaggataagagggcgaggagctcatcgctcgccacccccgtgggcttcttgggcgcaggtcggagctgggtgggccggctccccggcccctggcttgggcgaccatgtccgcatccgcccagcagctggcggaggagctgcagatcttcggcctagactgcgaggaggctctaattgagaaattggtagagctttgtgttcagtatggacagaatgaggagggaatggtaggcgagcttatagccttctgcaccagcacacataaagttggccttacctcagagatcctgaactcttttgagcatgagtttctgagcaaaagattatcgaaagccaggcatagtacctgcaaggacagtggccatgcaggagctagagacattgtttccattcaagagctaattgaagtggaagaagaagaggaaatcctcttgaactcttacaccacaccttcaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagaggaggagctggaaacatcagcctgaaggtcttgggatgtccagaggcactaactgggagctacaaatccatgtttcagaagctcccagacattcgagaagttctgacctgtaagatagaagaacttggcagcgaactcaaggaacattacaagattgaagctttcactcctttgctagccccagcacaggagcctgtcactctgctgggccagattggctgtgatagcaacgggaagctgaacaacaagtcagtgattctcgagggagaccgggaacattcctcgggtgctcaaattccagtggatttatctgagcttaaggaatattctctgtttcctggacaggttgtaattatggaaggaatcaacaccactggtaggaaacttgttgccaccaaactctacgagggtgtgccacttccattttatcagcccactgaagaggatgcagactttgagcaaagcatggtcctggttgcctgtggaccatacaccacatctgacagcatcacgtatgaccccctgcttgacctgattgctgtcatcaaccatgaccggccagatgtctgcatcctgtttggccctttcctggatgctaagcatgaacaggtggagaattgtctactgacaagtccatttgaagacattttcaagcagtgtctacgaacaattattgaaggcacaagaagctccggctcccaccttgtctttgtcccgtcattgagagatgtgcaccatgagcctgtgtacccccagccgcctttcagctactccgatctgtctcgagaggacaaaaagcaagtacagtttgtgtccgagccctgcagcctctccataaacggagtgatcttcggcttgacatccacagatctgcttttccacctgggggccgaggagatcagtagttcttccggaacttcagacagattcagccgaatactcaagcacatcttgacccagaggagctactacccactctacccgccccaagaagacatggccattgactatgagtcgttctatgtttacgcacagctgcctgtcaccccagatgtcctcatcatcccgtcagagctgaggtacttcgtgaaggatgtcctcggctgtgtctgtgtgaaccctgggcgccttaccaaagggcaggtgggaggcaccttcgcccgactctaccttaggaggccggcagcggacggggcagagaggcagagcccatgcattgctgtgcaggtcgtcaggatctgaggcttctgtcctctgctgttctctgctgtgtgggcccttaaagtcttagccaagagccaagacatagccctgtgacaaggtgaacagttgggtgggaaaggagagaggagccagccagggaggggcagctgcagtgaccaggcccagcagggaggacttgtgcagccgggcctgcctctgagtggtgcctctcctggaaggaagctcttgcttctcagtccatgctccgtgtccagaagtaagccagctgtggatcccgcccactcagaaaaggcgagaaggctttgtgattttctacatgaatcaaacacagaaacaacttttggagaaattaaattctgagtgtgacttctgagtttgacctttcttctattttcttttatttatttattttgtttttagacggagtctcgatctgtcgcccaggctggagtgcagtggtgagatctcggctcactgcaagctctgccgcccgggttcatgccattctcctgcctcagcctcctgagtagctgggactacaggcacccaccaccacgcctggctaattttttgtatttttagtggagatggggtttcaccatgttagccaggatggtctcgatctcctgaccttgtgatctgtccgcctcagcctcccaaagtgctgggattacaggcgtgagccaccgcgcccggcccctttcttctattttctttatcctggtagtagacaaagaatgttgcctatttgacctatgtccagagaaggcagagtgtcagtcacactgggtttctatccagccccagtcctgtccagtgggtaactctcagccccactcctcatcccccaaaggccccagtgacctctatgctgcagaggtgcactgggtgggccctagagctgggctgcagagcaagcaactggctgcatgcctgggcctccctgcgcagttcctcacatgcatgctgtggtcccagcctgacctctccatctggagggggccgcctcgctgggctgttccaaagctggagtcctggtggcagctgctttgccaagtcgcgcagtagccagggcttgcctgcagcccagaacactcagacagggtcaggccttccagggttcacagcacgtcccatgcccctatgtcctggcatctggggaaaagctgtcactggccagacgtggagtggcttcctgccctaagctggcaggctgtcctgcctcacatgccagagccaagaccggcaaaccccagctgtcagggcagggaagtgggcaagggggcagcaagctgctggtgtctatgccttgactccgagataaatagatgacctaacagtggccaacttttgcctctcacctttctgacggtgaaatggaatcgagccccagacctgaccagggtacagtaaaaggtcttcctttaaacacaa

SEQ ID NO: 167359 - DNA, 2403 bp, Homo sapiens
  Payload ID: 12928
  Gene Symbol: POLA2
  Gene Name: polymerase (DNA directed), alpha 2, accessory subunit
  ENST ID: ENST00000527850
  CDS Start-End: 374-487
cgtgcactgcacaaaccatttggcgggtttttccggccactcagttctgccaccgtcactgagaagctcagcggtagcttttgggaagcaggacgttctcaccaggagagcgtcctctcgagatttctgctccctccattcagggcgtttgggagccaccccttcattttttaaaaaaagtatttctctgtgaccgacggccggggccttctgacggtctgaggtcttgcttgggccagtcacctcctgtcacggtccgcggaggggggaaggataagagggcgaggagctcatcgctcgccacccccgtgggcttcttgggcgcaggtcggagctgggtgggccggctccccggcccctggcttgggcgaccatgtccgcatccgcccagcagctggcggaggagctgcagatcttcggcctagactgcgaggaggctctaattgagaaattttctgagcaaaagattatcgaaagccaggcatagtacctgcaaggacagtggccatgcaggagctagagacattgtttccattcaagagctaattgaagtggaagaagaagaggaaatcctcttgaactcttacaccacaccttcaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagaggaggagctggaaacatcagcctgaaggtcttgggatgtccagaggcactaactgggagctacaaatccatgtttcagaagctcccagacattcgagaagttctgacctgtaagatagaagaacttggcagcgaactcaaggaacattacaagattgaagctttcactcctttgctagccccagcacaggagcctgtcactctgctgggccagattggctgtgatagcaacgggaagctgaacaacaagtcagtgattctcgagggagaccgggaacattcctcgggtgctcaaattccagtggatttatctgagcttaaggaatattctctgtttcctggacaggttgtaattatggaaggaatcaacaccactggtaggaaacttgttgccaccaaactctacgagggtgtgccacttccattttatcagcccactgaagaggatgcagactttgagcaaagcatggtcctggttgcctgtggaccatacaccacatctgacagcatcacgtatgaccccctgcttgacctgattgctgtcatcaaccatgaccggccagatgtctgcatcctgtttggccctttcctggatgctaagcatgaacaggtggagaattgtctactgacaagtccatttgaagacattttcaagcagtgtctacgaacaattattgaaggcacaagaagctccggctcccaccttgtctttgtcccgtcattgagagatgtgcaccatgagcctgtgtacccccagccgcctttcagctactccgatctgtctcgagaggacaaaaagcaagtacagtttgtgtccgagccctgcagcctctccataaacggagtgatcttcggcttgacatccacagatctgcttttccacctgggggccgaggagatcagtagttcttccggaacttcagacagattcagccgaatactcaagcacatcttgacccagaggagctactacccactctacccgccccaagaagacatggccattgactatgagtcgttctatgtttacgcacagctgcctgtcaccccagatgtcctcatcatcccgtcagagctgaggtacttcgtgaaggtaggtttgaactctgctttttcccagaaacaccagaacccagtctttgactttcccttctagaccacccggcactcacccctcatgggtcagctgatggggatggggcctctagcaccctgccctgtggccttgtttctttggggaggtggtgggaccagaaaacaaacaactctgtcagtaaaatgcttgagtaaacagtgtcctctcctccctccccaagagaacgagagcccagatgactaggaaggccctcaaatgagggctttcaccaggccacatagaggtgacctggggaagatttcatatgtacacttgcctgtcctctgcctcccaaattctgatatgacctccaagtgggctcagctgggaataccttgaagaagctattgggtcattttgatctctgccaccctttagccctgcctgccttggagttaggtcccttacaaggaatctgcctagaccagtccccctcttgccaaacaagagttagttcaatctcaag

SEQ ID NO: 167360 - DNA, 580 bp, Homo sapiens
  Payload ID: 12928
  Gene Symbol: POLA2
  Gene Name: polymerase (DNA directed), alpha 2, accessory subunit
  ENST ID: ENST00000532391
  CDS Start-End: 143-580
gaataaacattgatggagtaaaccaggattatttttgcttttctaggtgaaacttcgagaaatgaactaagtttttacttgtccaattttcctttctacagtggtagagctttgtgttcagtatggacagaatgaggagggaatggtaggcgagcttatagccttctgcaccagcacacataaagttggccttacctcagagatcctgaactcttttgagcatgagtttctgagcaaaagattatcgaaagccaggcatagtacctgcaaggacagtggccatgcaggagctagagacattgtttccattcaagagctaattgaagtggaagaagaagaggaaatcctcttgaactcttacaccacaccttcaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagagga

SEQ ID NO: 167361 - DNA, 873 bp, Homo sapiens
  Payload ID: 12928
  Gene Symbol: POLA2
  Gene Name: polymerase (DNA directed), alpha 2, accessory subunit
  ENST ID: ENST00000525924
  CDS Start-End: 1-785
ctgaagaggatgcagactttgagcaaagcatggtcctggttgcctgtggaccatacaccacatctgacagcatcacgtatgaccccctgcttgacctgattgctgtcatcaaccatgaccggccagatgtctgcatcctgtttggccctttcctggatgctaagcatgaacaggtggagaattgtctactgacaagtccatttgaagacattttcaagcagtgtctacgaacaattattgaaggcacaagaagctccggctcccaccttgtctttgtcccgtcattgagagatgtgcaccatgagcctgtgtacccccagccgcctttcagctactccgatctgtctcgagaggacaaaaagcaagtacagtttgtgtccgagccctgcagcctctccataaacggagtgatcttcggcttgacatccacagatctgcttttccacctgggggccgaggagatcagtagttcttccggaacttcagacagattcagccgaatactcaagcacatcttgacccagaggagctactacccactctacccgccccaagaagacatggccattgactatgagtcgttctatgtttacgcacagctgcctgtcaccccagatgtcctcatcatcccgtcagagctgaggtacttcgtgaagtttttgcctttcagatggacaaaaatcaaaataggtggaaaccaggggctggtgagcctgaggagaaacagccctgttgactgtgtgggggcctggtacctggcacagtctccaagaaggacaagctgacagagctgacaaaatgaccactgcaagctgggcacggtggtgcgtgcctgtagtcccagccacgcaggaggccaaggcgggaggatgg

SEQ ID NO: 167362 - DNA, 1329 bp, Homo sapiens
  Payload ID: 12929
  Gene Symbol: POLB
  Gene Name: polymerase (DNA directed), beta
  Uniprot ID: P06746
  ENST ID: ENST00000265421
  CDS Start-End: 171-1178
aacaagcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 167363 - DNA, 720 bp, Homo sapiens
  Payload ID: 12929
  Gene Symbol: POLB
  Gene Name: polymerase (DNA directed), beta
  ENST ID: ENST00000519771
  CDS Start-End: 21-149
gttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattga

SEQ ID NO: 167364 - DNA, 401 bp, Homo sapiens
  Payload ID: 12929
  Gene Symbol: POLB
  Gene Name: polymerase (DNA directed), beta
  ENST ID: ENST00000517393
  CDS Start-End: 1-320
cagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 167365 - DNA, 653 bp, Homo sapiens
  Payload ID: 12929
  Gene Symbol: POLB
  Gene Name: polymerase (DNA directed), beta
  ENST ID: ENST00000524208
  CDS Start-End: 1-90
gcatctgttatagcaaaatacccacacaaaataaagagtggagctgaagctaagaaattgtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactg

SEQ ID NO: 167366 - DNA, 1341 bp, Homo sapiens
  Payload ID: 12929
  Gene Symbol: POLB
  Gene Name: polymerase (DNA directed), beta
  ENST ID: ENST00000522610
  CDS Start-End: 119-700
tcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagagattctgctgtctacatcaatacacctgaatagttggacagaaaattgaaatcttttaactaattctaactatgaagcacagtgaaatagaaagttaggctgtaagaagtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcat

SEQ ID NO: 167367 - DNA, 863 bp, Homo sapiens
  Payload ID: 12929
  Gene Symbol: POLB
  Gene Name: polymerase (DNA directed), beta
  ENST ID: ENST00000521290
  CDS Start-End: 1-712
tgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 167368 - DNA, 744 bp, Homo sapiens
  Payload ID: 12929
  Gene Symbol: POLB
  Gene Name: polymerase (DNA directed), beta
  ENST ID: ENST00000518579
  CDS Start-End: 1-719
ttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactgtccttcaggcaacgagagaggatttaatgcataacatgctcctaggccctcagttgaaggccatcaaggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgatt

SEQ ID NO: 167369 - DNA, 725 bp, Homo sapiens
  Payload ID: 12929
  Gene Symbol: POLB
  Gene Name: polymerase (DNA directed), beta
  ENST ID: ENST00000520008
  CDS Start-End: 571-725
agcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaa

SEQ ID NO: 167370 - DNA, 983 bp, Homo sapiens
  Payload ID: 12929
  Gene Symbol: POLB
  Gene Name: polymerase (DNA directed), beta
  ENST ID: ENST00000518925
  CDS Start-End: 144-983
tcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaaggctcacagctggattcatgcccagtaaagggacacctgaatggaactgagtcacttttagacttaatatgggatgttatgacaattcttaagttaaaaaatgcagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaat

SEQ ID NO: 167371 - DNA, 786 bp, Homo sapiens
  Payload ID: 12929
  Gene Symbol: POLB
  Gene Name: polymerase (DNA directed), beta
  ENST ID: ENST00000521492
  CDS Start-End: 471-635
tcatcgtttcttccacgttgctctcttctgtttattttgatgtctgtgtttcgtgttcagggttttctttgattagtttcttgcttagaatcacacaaagaccaaatcctcataatgagaatccttatttgcagttttgtgtagttctctaattatcgtgaagtgtaatagaaaggtagggatagtgtattgctcacagaagctgctaagttaaaagtgctcagaattctagagctgctaacattaaaaacaaaaatggccttgtgttttacttgattaaaattaagccttaagtttagaacatctttaaacttggtttaaaatgttcattttagggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 167372 - DNA, 675 bp, Homo sapiens
  Payload ID: 12929
  Gene Symbol: POLB
  Gene Name: polymerase (DNA directed), beta
  ENST ID: ENST00000532157
  CDS Start-End: 561-675
caacaagcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaaggctcacagctggattcatgcccagtaaagggacacctgaatggaactgagtcacttttagacttaatatgggatgttatgacaattcttaagttaaaaaatgcagatctcagaaaaaatgaagataaattgaaccatcatcagcgaattgggctgaaatattttggggactttgaaaaaagaattcctcgtg

SEQ ID NO: 167373 - DNA, 3444 bp, Homo sapiens
  Payload ID: 12930
  Gene Symbol: POLD1
  Gene Name: polymerase (DNA directed), delta 1, catalytic subunit
  Uniprot ID: P28340
  ENST ID: ENST00000440232
  CDS Start-End: 54-3377
agtcaggggtcacggcggcgtaggctgtggcgggaaacgctgtttgaagcgggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgcta

SEQ ID NO: 167374 - DNA, 867 bp, Homo sapiens
  Payload ID: 12930
  Gene Symbol: POLD1
  Gene Name: polymerase (DNA directed), delta 1, catalytic subunit
  ENST ID: ENST00000593407
  CDS Start-End: 1-867
ctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggtcctgcgcggggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctg

SEQ ID NO: 167375 - DNA, 873 bp, Homo sapiens
  Payload ID: 12930
  Gene Symbol: POLD1
  Gene Name: polymerase (DNA directed), delta 1, catalytic subunit
  ENST ID: ENST00000593981
  CDS Start-End: 1-873
tggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcgga

SEQ ID NO: 167376 - DNA, 563 bp, Homo sapiens
  Payload ID: 12930
  Gene Symbol: POLD1
  Gene Name: polymerase (DNA directed), delta 1, catalytic subunit
  ENST ID: ENST00000596425
  CDS Start-End: 1-563
cgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaagagcgtcacggggttcggacgtcagatgatcgagaaaaccaagcagctggtggagtctaagtacacagtggagaatg

SEQ ID NO: 167377 - DNA, 3474 bp, Homo sapiens
  Payload ID: 12930
  Gene Symbol: POLD1
  Gene Name: polymerase (DNA directed), delta 1, catalytic subunit
  ENST ID: ENST00000600859
  CDS Start-End: 189-3218
gccacttcggaagctgagagagggggcggggcctgccctgcagtcgaacaagcggggcgtggccttgcccgcacttgggcaggcgggggcgtggcccgtctctgagcgccgcggctctgggcttgcgcgcgcgggagtcaggggtcacggcggcgtaggctgtggcgggaaacgctgtttgaagcgggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgc

SEQ ID NO: 167378 - DNA, 3402 bp, Homo sapiens
  Payload ID: 12930
  Gene Symbol: POLD1
  Gene Name: polymerase (DNA directed), delta 1, catalytic subunit
  ENST ID: ENST00000595904
  CDS Start-End: 1-3402
atggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaaggggtgaggccacaagacagggcgggggcggcatgggaactcctagccctgactcccggccgcggctgctcccctcccaggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtga

SEQ ID NO: 167379 - DNA, 783 bp, Homo sapiens
  Payload ID: 12930
  Gene Symbol: POLD1
  Gene Name: polymerase (DNA directed), delta 1, catalytic subunit
  ENST ID: ENST00000601098
  CDS Start-End: 177-783
caggggtcacggcggcgtaggctgtggcgggaaacgctgtttgaagcggtagagacagggtttcaccatgttgataaggctggtctcaaacaactgacctcaagtgatccacccgcctcggcctctcaaagtgctgggattataggtgcgagccacggtgcccagctgggtacaggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagtgagtgctcccccagga

SEQ ID NO: 167380 - DNA, 695 bp, Homo sapiens
  Payload ID: 12930
  Gene Symbol: POLD1
  Gene Name: polymerase (DNA directed), delta 1, catalytic subunit
  ENST ID: ENST00000593887
  CDS Start-End: 380-695
aaacgctgtttgaagcggcttcagcactgactctgggctcccacaagcccctgcgcttcctctgtcccacccgggtctctcctcgcagatcatcactccctgtccctctctggctacttgcacaacccgaagccagagccgctaacgacgcttgcttcttcctgtctaagctgttgtaccaaggagcccccaaaacacagtggcccaagaaagatacaaattgatttctccacataacgctttggaagatagtagagacagggtttcaccatgttgataaggctggtctcaaacaactgacctcaagtgatccacccgcctcggcctctcaaagtgctgggattataggtgcgagccacggtgcccagctgggtacaggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgg

SEQ ID NO: 167381 - DNA, 3435 bp, Homo sapiens
  Payload ID: 12930
  Gene Symbol: POLD1
  Gene Name: polymerase (DNA directed), delta 1, catalytic subunit
  Uniprot ID: P28340
  ENST ID: ENST00000599857
  CDS Start-End: 45-3368
cggcggcgtaggctgtggcgggaaacgctgtttgaagcggcaggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgcta

SEQ ID NO: 167382 - DNA, 3542 bp, Homo sapiens
  Payload ID: 12930
  Gene Symbol: POLD1
  Gene Name: polymerase (DNA directed), delta 1, catalytic subunit
  ENST ID: ENST00000613923
  CDS Start-End: 70-3471
ggcttgcgcgcgcgggagtcaggggtcacggcggcgtaggctgtggcgggaaacgctgtttgaagcgggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaaggggtgaggccacaagacagggcgggggcggcatgggaactcctagccctgactcccggccgcggctgctcccctcccaggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgctatatg

SEQ ID NO: 167383 - DNA, 1597 bp, Homo sapiens
  Payload ID: 12931
  Gene Symbol: POLD2
  Gene Name: polymerase (DNA directed), delta 2, accessory subunit
  ENST ID: ENST00000223361
  CDS Start-End: 144-1511
gtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcac

SEQ ID NO: 167384 - DNA, 2158 bp, Homo sapiens
  Payload ID: 12931
  Gene Symbol: POLD2
  Gene Name: polymerase (DNA directed), delta 2, accessory subunit
  Uniprot ID: P49005
  ENST ID: ENST00000406581
  CDS Start-End: 651-2060
gagtggggtccagggaaacggggtcagctgggggtggcagttccaggccgcgaggccgggctcctgggtcggtgggctggtgtcttggcggacgtcccgcagctgccgcgtggatccgagccggggcacccgccgtgactgggacagcccccagggcgctctcggccccatcccgagtagcgcggcctggctgctgccgccatcaagcacgttcgagccaaaagctcctaacgagtcactcgttagacacgtgtgcggagcctgtgtcccaggccagtgctgtcccgtggagatagattgcaagccgctagggaattttttaactttctagtgccggagagctggatggaggcagatcgggaattccatttggggcaaactgaacttgattgagaccctggtagttgtccagatggaacaggacacctgagtctagggttcgggaagaactccagatgggacaaacactcctagctttccttttctctttttggatgaccgctacaggtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 167385 - DNA, 765 bp, Homo sapiens
  Payload ID: 12931
  Gene Symbol: POLD2
  Gene Name: polymerase (DNA directed), delta 2, accessory subunit
  ENST ID: ENST00000433715
  CDS Start-End: 106-765
gcggcgggaagagcccgggaagcttagtggggaagcgtctcttgatgggtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggat

SEQ ID NO: 167386 - DNA, 1659 bp, Homo sapiens
  Payload ID: 12931
  Gene Symbol: POLD2
  Gene Name: polymerase (DNA directed), delta 2, accessory subunit
  Uniprot ID: P49005
  ENST ID: ENST00000452185
  CDS Start-End: 250-1659
gggatgcggcgcgccgcgcgggtgagacatcggtatccaggcacgataaatttccaagtggacacaatgtctggtgtcaactacagctgttctccttcttttcccagtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctga

SEQ ID NO: 167387 - DNA, 665 bp, Homo sapiens
  Payload ID: 12931
  Gene Symbol: POLD2
  Gene Name: polymerase (DNA directed), delta 2, accessory subunit
  ENST ID: ENST00000456038
  CDS Start-End: 200-665
cacagttggactcaccacatctcctgtacttcgtagccctaggtggctagtggcataagacacaaaaatctcagctctcctggagcttatggtctagttggagcaggcagacaatacatttaaaatatacagtttgttagaagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacgg

SEQ ID NO: 167388 - DNA, 249 bp, Homo sapiens
  Payload ID: 12931
  Gene Symbol: POLD2
  Gene Name: polymerase (DNA directed), delta 2, accessory subunit
  ENST ID: ENST00000436400
  CDS Start-End: 1-249
gccaaatacctcaccaagaaaacccaggcagccagcgtggaggctgttaagatgctggatgagatcctcctgcagctgagccagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatc

SEQ ID NO: 167389 - DNA, 556 bp, Homo sapiens
  Payload ID: 12931
  Gene Symbol: POLD2
  Gene Name: polymerase (DNA directed), delta 2, accessory subunit
  ENST ID: ENST00000418438
  CDS Start-End: 113-556
agtggtcggcgggatgaggcgcctggtgacggacggggcgaggagggcagcgattgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccatt

SEQ ID NO: 167390 - DNA, 854 bp, Homo sapiens
  Payload ID: 12931
  Gene Symbol: POLD2
  Gene Name: polymerase (DNA directed), delta 2, accessory subunit
  ENST ID: ENST00000436844
  CDS Start-End: 84-854
gattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactgggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtc

SEQ ID NO: 167391 - DNA, 1619 bp, Homo sapiens
  Payload ID: 12931
  Gene Symbol: POLD2
  Gene Name: polymerase (DNA directed), delta 2, accessory subunit
  ENST ID: ENST00000610533
  CDS Start-End: 1-1515
atgggcggggcaggcgcgcggggattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcgagccttg

SEQ ID NO: 167392 - DNA, 1776 bp, Homo sapiens
  Payload ID: 12932
  Gene Symbol: POLE2
  Gene Name: polymerase (DNA directed), epsilon 2, accessory subunit
  Uniprot ID: P56282
  ENST ID: ENST00000216367
  CDS Start-End: 101-1684
taacagggtttagcgccacgcgggccagggccgaggccggagctgggaggggcgcgcccgggaaggggcggagctgcggcggtggcgccaaatcgcaaatatggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactatagagcacgttttcaatatcataggagcatttgatattccacgctttgtgtacaattcagaaagaaaaaaatttcttcctctgttaatgaccaaccaccctgcaccaaatttatttggaacaccaagagataaagcagagatgtttcgtgagcgatataccattttgcaccagaggacccacaggcatgaattatttactcctccggtgataggttctcaccctgatgaaagcggaagcaaattccagcttaaaacaatagaaaccttattgggtagtacaaccaaaatcggagatgcgattgttcttggaatgataacgcagttaaaagagggaaaattttttctggaagatcctactggaacagtccaactagaccttagtaaagctcagttccatagtggtttatacacagaggcatgctttgtcttagcagaaggttggtttgaagatcaagtgtttcatgtcaatgcctttggatttccacccactgagccctctagtactactagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctggttattcaccagcacctccaacctgctttattctgtgtggtaatttttcatctgcaccatatggaaaaaatcaagttcaagctttgaaagattccctaaaaactttggcagatataatatgtgaatacccagatattcaccaaagtagtcgttttgtgtttgtacctggtccagaggatcctggatttggttccatcttaccaaggccaccacttgctgaaagcatcactaatgaattcagacaaagggtaccattttcagtttttactactaatccttgcagaattcagtactgtacacaggaaattactgtcttccgtgaagacttagtaaataaaatgtgcagaaactgcgtccgttttcctagcagcaatttggctattcctaatcactttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctggctcttttccaagaagtggattttcattcaaagttttttatccttctaataagacagtagaagatagcaaacttcaaggcttttgagattcttaaagatcatctgaagaaaattcatcagttttctgcttaactctatatcttatgtgattctgatattacaataaaattatggtaaa

SEQ ID NO: 167393 - DNA, 1792 bp, Homo sapiens
  Payload ID: 12932
  Gene Symbol: POLE2
  Gene Name: polymerase (DNA directed), epsilon 2, accessory subunit
  Uniprot ID: P56282
  ENST ID: ENST00000539565
  CDS Start-End: 220-1725
agtttcccggcagcaaaggagcgcgaggtggtctccactttcagcctactcggtccggggttgcgaactgtaaggtctgagttgctgcggcgcaggcagcggagaccaagcagggatcttaacagggtttagcgccacgcgggccagggccgaggccggagctgggaggggcgcgcccgggaaggggcggagctgcggcggtggcgccaaatcgcaaatatggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactattctgttaatgaccaaccaccctgcaccaaatttatttggaacaccaagagataaagcagagatgtttcgtgagcgatataccattttgcaccagaggacccacaggcatgaattatttactcctccggtgataggttctcaccctgatgaaagcggaagcaaattccagcttaaaacaatagaaaccttattgggtagtacaaccaaaatcggagatgcgattgttcttggaatgataacgcagttaaaagagggaaaattttttctggaagatcctactggaacagtccaactagaccttagtaaagctcagttccatagtggtttatacacagaggcatgctttgtcttagcagaaggttggtttgaagatcaagtgtttcatgtcaatgcctttggatttccacccactgagccctctagtactactagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctggttattcaccagcacctccaacctgctttattctgtgtggtaatttttcatctgcaccatatggaaaaaatcaagttcaagctttgaaagattccctaaaaactttggcagatataatatgtgaatacccagatattcaccaaagtagtcgttttgtgtttgtacctggtccagaggatcctggatttggttccatcttaccaaggccaccacttgctgaaagcatcactaatgaattcagacaaagggtaccattttcagtttttactactaatccttgcagaattcagtactgtacacaggaaattactgtcttccgtgaagacttagtaaataaaatgtgcagaaactgcgtccgttttcctagcagcaatttggctattcctaatcactttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctggctcttttccaagaagtggattttcattcaaagttttttatccttctaataagacagtagaagatagcaaacttcaaggcttttgagattcttaaagatcatctgaagaaaattcatcagttttctgcttaactctatatcttatgtgattct

SEQ ID NO: 167394 - DNA, 1581 bp, Homo sapiens
  Payload ID: 12932
  Gene Symbol: POLE2
  Gene Name: polymerase (DNA directed), epsilon 2, accessory subunit
  Uniprot ID: P56282
  ENST ID: ENST00000554396
  CDS Start-End: 8-1516
cgcaaatatggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactatagagcacgttttcaatatcataggagcatttgatattccacgctttgtgtacaattcagaaagaaaaaaatttcttcctctgttaatgaccaaccaccctgcaccaaatttatttggaacaccaagagataaagcagagatgtttcgtgagcgatataccattttgcaccagaggacccacaggcatgaattatttactcctccggtgataggttctcaccctgatgaaagcggaagcaaattccagcttaaaacaatagaaaccttattgggtagtacaaccaaaatcggagatgcgattgttcttggaatgataacgcagttaaaagagggaaaattttttctggaagatcctactggaacagtccaactagaccttagtaaagctcagttccatagtggtttatacacagaggcatgctttgtcttagcagaaggttggtttgaagatcaagtgtttcatgtcaatgcctttggatttccacccactgagccctctagtactactagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctggttattcaccagcacctccaacctgctttattctgtgtggtaatttttcatctgcaccatatggaaaaaatcaagttcaagctttgaaagattccctaaaaactttggcagatataatatgtgaatacccagatattcaccaaagtagtcgttttgtgtttgtacctggtccagaggatcctggatttggttccatcttaccaaggccaccacttgctgaaagcatcactaatgaattcagacaaagggtaccattttcagtttttactactaatccttgcagaattcagtactgtacacaggaaattactgtcttccgtgaagacttagtaaataaaatgtgcagaaactgcgtccgttttcctagcagcaatttggctattcctaatcactttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctgtaagaatgtagttaatcttatatagtcattatttatcaagattagagtgcattttttaatttaaaaatatatattt

SEQ ID NO: 167395 - DNA, 496 bp, Homo sapiens
  Payload ID: 12932
  Gene Symbol: POLE2
  Gene Name: polymerase (DNA directed), epsilon 2, accessory subunit
  ENST ID: ENST00000553805
  CDS Start-End: 1-291
atggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactatgtatgtgggtacagttaacttttttcctccttggaggtgttattgagcacttatttttaattattgtcttggaaaattattagtgatcaacgtttctacagtgattactgttgttatttctgtgtgtctttttaaataatggctttctttgcaaacctcattattaaatgactcatctttactggtttttcctgggatttgaggttacagtgttgcttgtaccattcattactaacttttgctgcctaccc

SEQ ID NO: 167396 - DNA, 2109 bp, Homo sapiens
  Payload ID: 12933
  Gene Symbol: POLE3
  Gene Name: polymerase (DNA directed), epsilon 3, accessory subunit
  Uniprot ID: Q9NRF9
  ENST ID: ENST00000374169
  CDS Start-End: 90-533
gcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaa

SEQ ID NO: 167397 - DNA, 2191 bp, Homo sapiens
  Payload ID: 12933
  Gene Symbol: POLE3
  Gene Name: polymerase (DNA directed), epsilon 3, accessory subunit
  Uniprot ID: Q9NRF9
  ENST ID: ENST00000374171
  CDS Start-End: 172-615
agcggcgcagggcaccatgggaaacggacggaagctccattgagccaaataagttggccacgtggggcggaacggaaacctcgcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaa

SEQ ID NO: 167398 - DNA, 7840 bp, Homo sapiens
  Payload ID: 12934
  Gene Symbol: POLE
  Gene Name: polymerase (DNA directed), epsilon, catalytic subunit
  Uniprot ID: Q07864
  ENST ID: ENST00000320574
  CDS Start-End: 45-6905
cgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacgtccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcagagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccaggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttc

SEQ ID NO: 167399 - DNA, 8011 bp, Homo sapiens
  Payload ID: 12934
  Gene Symbol: POLE
  Gene Name: polymerase (DNA directed), epsilon, catalytic subunit
  ENST ID: ENST00000537064
  CDS Start-End: 33-965
cccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacgtccatcagcacagcaaagcgcctggccgagttcctgggagaccagatggtcaaggatgcagggctgagttgccgctacatcatctcccgcaagcccgagggctcccctgtcacggagaggtctccttatgtttgcagtattcaccacagatgtttcctccagtgaaagggaagcactgacggttgccagttgctttgctagtgacatgaaaacaggctcgttttttctagaaagcagcctgagtcttctgtgtgttactcagcaaggaacatgtagacatggttatgaacgtgcacgtttgcctgtatgcatgcacgtggttactcagaaacgcagacatgtttacgcacacacgcatgtctttgcctatacgcatgcgcgtggttactcagaaacgtagacatgtttacgcacgcatgcgtttatgtatgtgcatgcacatggttatgccgtgagaaacatgtagacatagttacgaacatgcacgtgtttgcctgtacgcatgcacgtggttactcaatgagaaacgcagacatgtctacgcacacgcatgtgtttatgtatatgcatgcccatggttacgctgtgaggaacatgtagacatgtttacgtgcacacacgcacgtgtttacacatacgcacgtgttactccccgaggaacctgtaggcatgtttgtgcatacatatgcacgcagatgtatacattgatgtttgtgaacagctgttacacgtccttatttccatgttcatttgataagagttaggatcagattttgggtgattttcactgttactgagctgtgtgcctgtcttccttacccagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcagagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacg

SEQ ID NO: 167400 - DNA, 6800 bp, Homo sapiens
  Payload ID: 12934
  Gene Symbol: POLE
  Gene Name: polymerase (DNA directed), epsilon, catalytic subunit
  ENST ID: ENST00000535270
  CDS Start-End: 14-6793
agccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctgtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacgtccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcagagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccc

SEQ ID NO: 167401 - DNA, 659 bp, Homo sapiens
  Payload ID: 12934
  Gene Symbol: POLE
  Gene Name: polymerase (DNA directed), epsilon, catalytic subunit
  ENST ID: ENST00000544870
  CDS Start-End: 1-451
ttctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggattatgtcgcaaatgagctcactcagagcttcttcaccatcactcagaagattcagaagaaagtcacaggctctcggaactccactgagctctcagagatgtttcctgtcctccccggttcccacttgctgctcaataaccctgccctggagttcatcaaatacgtgtgcaaggtgctgtccctggacaccaacatcacaaaccaggtgaataagctgaaccga

SEQ ID NO: 167402 - DNA, 556 bp, Homo sapiens
  Payload ID: 12934
  Gene Symbol: POLE
  Gene Name: polymerase (DNA directed), epsilon, catalytic subunit
  ENST ID: ENST00000441786
  CDS Start-End: 1-464
caatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccgattcagaagaaagtcacaggctctcggaactccactgagctctcagagatgtttcctgtcctccccggttcccacttgctgctcaataaccctgccctggagttcatcaaatacgtgtgcaaggtgctgt

SEQ ID NO: 167403 - DNA, 3322 bp, Homo sapiens
  Payload ID: 12935
  Gene Symbol: POLH
  Gene Name: polymerase (DNA directed), eta
  Uniprot ID: Q9Y253
  ENST ID: ENST00000372226
  CDS Start-End: 149-1393
ataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaaaaatggctactggacaggatcgagtggttgctctcgtggacatggactgtttttttgttcaagtggagcagcggcaaaatcctcatttgaggaataaaccttgtgcagttgtacagtacaaatcatggaagggtggtggaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaagaggggatgcgaaaacaaggcttatttcaatggctcgattctcttcagattgataacctcacctctccagacctgcagctcaccgtgggagcagtgattgtggaggaaatgagagcagccatagagagggagactggttttcagtgttcagctggaatttcacacaataaggtcctggcaaaactggcctgtggactaaacaagcccaaccgccaaaccctggtttcacatgggtcagtcccacagctcttcagccaaatgcccattcgcaaaatccgtagtcttggaggaaagctaggggcctctgtcattgagatcctagggatagaatacatgggtgaactgacccagttcactgaatcccagctccagagtcattttggggagaagaatgggtcttggctatatgccatgtgccgagggattgaacatgatccagttaaacccaggcaactacccaaaaccattggctgtagtaagaacttcccaggaaaaacagctcttgctactcgggaacaggtacaatggtggctgttgcaattagcccaggaactagaggagagactgactaaagaccgaaatgataatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatgacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgcaaacattggaatcattttttaagccattaacacattagtgctgccctcaggcttgcctgtaggatttaatattttttatctttacagatctttatctttaatattttatctttacagatttccctgagaaagggaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtgggccttggagtctaagagacgtggttgcaaacttagctctggttattgcaatgagggccttgaacaagtcattttcttcacattctcatctgtaaaatggagataataccttacagattattgcagattaataacaatgtattcaaattatgtaactcggccgggtacaatggctcacgcctgtaatcctaacactttgggaggccgaggcagacagatcacctgaggtcaggagtttgagaccagcctggccaacatggcaaaaccatctctactaaaaatagaaaaattagccaggcacgttccaggcacctgtgatcccagctacttagaggctgaggcagaagaattgctttaaccttggaggcggaggttgcattgagctgagatcatgctagtgcgctccagcctgggcaacagagcgagacttcatctcagaaaataaaaaataggggccaggcacagtggctcatacctgtaatgccagcactttgggaggccaaggcgggcagatcacgaggtcaggagtttcagaccaatatggtgaaaccccatctctactaaaattacaaaaaaaattatccaggcgtggtggtgcacgcctgtaatcccagctactcaggaggctaaggcaggagaatcacttgaacccaggaggcagaggttggagtgagctgagatcgcgccaccgcactccagcctgggcaacagagcgagactccatctcaaacaaaaacaagaacaaaaacaaacataaagttggcacagaaaagggaccaagtttaaaaaagggttttaaatgtaatgagacttgcatagttaaaaaaaaaaaa

SEQ ID NO: 167404 - DNA, 3540 bp, Homo sapiens
  Payload ID: 12935
  Gene Symbol: POLH
  Gene Name: polymerase (DNA directed), eta
  Uniprot ID: Q9Y253
  ENST ID: ENST00000372236
  CDS Start-End: 296-2437
aacggcccttcgcagcgggcgcgctgtcagacctcagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaaaaatggctactggacaggatcgagtggttgctctcgtggacatggactgtttttttgttcaagtggagcagcggcaaaatcctcatttgaggaataaaccttgtgcagttgtacagtacaaatcatggaagggtggtggaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaagaggggatgcgaaaacaaggcttatttcaatggctcgattctcttcagattgataacctcacctctccagacctgcagctcaccgtgggagcagtgattgtggaggaaatgagagcagccatagagagggagactggttttcagtgttcagctggaatttcacacaataaggtcctggcaaaactggcctgtggactaaacaagcccaaccgccaaaccctggtttcacatgggtcagtcccacagctcttcagccaaatgcccattcgcaaaatccgtagtcttggaggaaagctaggggcctctgtcattgagatcctagggatagaatacatgggtgaactgacccagttcactgaatcccagctccagagtcattttggggagaagaatgggtcttggctatatgccatgtgccgagggattgaacatgatccagttaaacccaggcaactacccaaaaccattggctgtagtaagaacttcccaggaaaaacagctcttgctactcgggaacaggtacaatggtggctgttgcaattagcccaggaactagaggagagactgactaaagaccgaaatgataatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatggtctcctcctctcacaatgcttttcctctgtgctacaaaattttctgcctctgccccttcatcttctacagacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgcaaacattggaatcattttttaagccattaacacattagtgctgccctcaggcttgcctgtaggatttaatattttttatctttacagatctttatctttaatattttatctttacagatttccctgagaaagggaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtgggccttggagtctaagagacgtggttgcaaacttagctctggttattgcaatgagggccttgaacaagtcattttcttcacattctcatctgtaaaatggagataataccttacagattattgcagattaataacaatgtattcaaattatgtaactcggccgggtacaatggctcacgcctgtaatcctaacactttgggaggccgaggcagacagatcacctgaggtcaggagtttgagaccagcctggccaacatggcaaaaccatctctactaaaaatagaaaaattagccaggcacgttccaggcacctgtgatcccagctacttagaggctgaggcagaagaattgctttaaccttggaggcggaggttgcattgagctgagatcatgctagtgcgctccagcctgggcaacagagcgagacttcatctcagaaaataaaaaataggggccaggcacagtggctcatacctgtaatgccagcactttgggaggccaaggcgggcagatcacgaggtcaggagtttcagaccaatatggtgaaaccccatctctactaaaattacaaaaaaaattatccaggcgtggtggtgcacgcctgtaatcccagctactcaggaggctaaggcaggagaatcacttgaacccaggaggcagaggttggagtgagctgagatcgcgccaccgcactccagcctgggcaacagagcgagactccatctcaaacaaaaacaagaacaaaaacaaacataaagttggcacagaaaagggaccaagtttaaaaaagggttttaaatgtaatgagacttgcatagttaaaaaaaaaaaa

SEQ ID NO: 167405 - DNA, 331 bp, Homo sapiens
  Payload ID: 12935
  Gene Symbol: POLH
  Gene Name: polymerase (DNA directed), eta
  ENST ID: ENST00000443535
  CDS Start-End: 117-331
agtaggcaccgaacccagcattttcggcaaccgctgctggcagttttgccaggtgtttgttaccttgaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaagg

SEQ ID NO: 167406 - DNA, 4500 bp, Homo sapiens
  Payload ID: 12936
  Gene Symbol: POLG
  Gene Name: polymerase (DNA directed), gamma
  Uniprot ID: P54098
  ENST ID: ENST00000268124
  CDS Start-End: 335-4054
gtagccgcgggacctagctgggtgcagacgggaagttgcggctgccagcgaagcggaccggccgggtggaggccacacgctaccccgaggctgcgtaggccgcgcgaagggggacgccgtgccgtgggcctggggtcgggggagcagcagaccgggaagcaccgtgaggaccgaggatttggggtggaaggcaggcatggtcaaacccatttcactgacaggagagcagagacaggacgtgtctctctccacgtcttccagccagtaaaagaagccaagctggagcccaaagccaggtgttctgactcccagcgtgggggtccctgcaccaaccatgagccgcctgctctggaggaaggtggccggcgccaccgtcgggccagggccggttccagctccggggcgctgggtctccagctccgtccccgcgtccgaccccagcgacgggcagcggcggcggcagcagcagcagcagcagcagcagcagcagcaacagcagcctcagcagccgcaagtgctatcctcggagggcgggcagctgcggcacaacccattggacatccagatgctctcgagagggctgcacgagcaaatcttcgggcaaggaggggagatgcctggcgaggccgcggtgcgccgcagcgtcgagcacctgcagaagcacgggctctgggggcagccagccgtgcccttgcccgacgtggagctgcgcctgccgcccctctacggggacaacctggaccagcacttccgcctcctggcccagaagcagagcctgccctacctggaggcggccaacttgctgttgcaggcccagctgcccccgaagcccccggcttgggcctgggcggagggctggacccggtacggccccgagggggaggccgtacccgtggccatccccgaggagcgggccctggtgttcgacgtggaggtctgcttggcagagggaacttgccccacattggcggtggccatatccccctcggcctggtattcctggtgcagccagcggctggtggaagagcgttactcttggaccagccagctgtcgccggctgacctcatccccctggaggtccctactggtgccagcagccccacccagagagactggcaggagcagttagtggtggggcacaatgtttcctttgaccgagctcatatcagggagcagtacctgatccagggttcccgcatgcgtttcctggacaccatgagcatgcacatggccatctcagggctaagcagcttccagcgcagtctgtggatagcagccaagcagggcaaacacaaggtccagccccccacaaagcaaggccagaagtcccagaggaaagccagaagaggcccagcgatctcatcctgggactggctggacatcagcagtgtcaacagtctggcagaggtgcacagactttatgtaggggggcctcccttagagaaggagcctcgagaactgtttgtgaagggcaccatgaaggacattcgtgagaacttccaggacctgatgcagtactgtgcccaggacgtgtgggccacccatgaggttttccagcagcagctaccgctcttcttggagaggtgtccccacccagtgactctggccggcatgctggagatgggtgtctcctacctgcctgtcaaccagaactgggagcgttacctggcagaggcacagggcacttatgaggagctccagcgggagatgaagaagtcgttgatggatctggccaatgatgcctgccagctgctctcaggagagaggtacaaagaagacccctggctctgggacctggagtgggacctgcaagaatttaagcagaagaaagctaagaaggtgaagaaggaaccagccacagccagcaagttgcccatcgagggggctggggcccctggtgatcccatggatcaggaagacctcggcccctgcagtgaggaggaggagtttcaacaagatgtcatggcccgcgcctgcttgcagaagctgaaggggaccacagagctcctgcccaagcggccccagcaccttcctggacaccctggatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacagagccatcgagtccctgtacaggaagcactgtctcgaacaggggaagcagcagctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctgactgcccgtggtggccccaaggacacccagcccagctatcaccatggcaatggaccttacaacgacgtggacatccctggctgctggtttttcaagctgcctcacaaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcagctcccagatggtggtgtggctgcccaggtcagctctgccccgtgctgtgatcaggcaccccgactatgatgaggaaggcctctatggggccatcctgccccaagtggtgactgccggcaccatcactcgccgggctgtggagcccacatggctcaccgccagcaatgcccggcctgaccgagtaggcagtgagttgaaagccatggtgcaggccccacctggctacacccttgtgggtgctgatgtggactcccaagagctgtggattgcagctgtgcttggagacgcccactttgccggcatgcatggctgcacagcctttgggtggatgacactgcagggcaggaagagcaggggcactgatctacacagtaagacagccactactgtgggcatcagccgtgagcatgccaaaatcttcaactacggccgcatctatggtgctgggcagccctttgctgagcgcttactaatgcagtttaaccaccggctcacacagcaggaggcagctgagaaggcccagcagatgtacgctgccaccaagggcctccgctggtatcggctgtcggatgagggcgagtggctggtgagggagttgaacctcccagtggacaggactgagggtggctggatttccctgcaggatctgcgcaaggtccagagagaaactgcaaggaagtcacagtggaagaagtgggaggtggttgctgaacgggcatggaaggggggcacagagtcagaaatgttcaataagcttgagagcattgctacgtctgacataccacgtaccccggtgctgggctgctgcatcagccgagccctggagccctcggctgtccaggaagagtttatgaccagccgtgtgaattgggtggtacagagctctgctgttgactacttacacctcatgcttgtggccatgaagtggctgtttgaagagtttgccatagatgggcgcttctgcatcagcatccatgacgaggttcgctacctggtgcgggaggaggaccgctaccgcgctgccctggccttgcagatcaccaacctcttgaccaggtgcatgtttgcctacaagctgggtctgaatgacttgccccagtcagtcgcctttttcagtgcagtcgatattgaccggtgcctcaggaaggaagtgaccatggattgtaaaaccccttccaacccaactgggatggaaaggagatacgggattccccagggtgaagcgctggatatttaccagataattgaactcaccaaaggctccttggaaaaacgaagccagcctggaccatagcactgcctggaggctctgtatttgctcccgtggagcttcatcggggtggtgcaggctcccaaactcaggctttcagctgtgctttttgcaaaagggcttgcctaaggccagccatttttcagtagcaggacctgccaagaagattccttctaactgaaggtgcagttgaattcagtgggttcagaaccaagatgccaacatcggtgtggactacaggacaaggggcattgttgcttgttgggtaaaaatgaagcagaagccccaaagttcacattaactcaggcatttcatttattttttccttttcttcttggctggttctttgttctgtcccccatgctctgatgcagtgccctagaaggggaaagaattaatgctctaacgtgataaacctgctccaaggcagtggaaataaaaagaaggaaaaaaaagactctatcttctca

SEQ ID NO: 167407 - DNA, 4487 bp, Homo sapiens
  Payload ID: 12936
  Gene Symbol: POLG
  Gene Name: polymerase (DNA directed), gamma
  Uniprot ID: P54098
  ENST ID: ENST00000442287
  CDS Start-End: 337-4056
cgcttgcctctcgggtagccgcgggacctagctgggtgcagacgggaagttgcggctgccagcgaagcggaccggccgggtggaggccacacgctaccccgaggctgcgtaggccgcgcgaagggggacgccgtgccgtgggcctggggtcgggggagcagcagaccgggaagcaccgatttggggtggaaggcaggcatggtcaaacccatttcactgacaggagagcagagacaggacgtgtctctctccacgtcttccagccagtaaaagaagccaagctggagcccaaagccaggtgttctgactcccagcgtgggggtccctgcaccaaccatgagccgcctgctctggaggaaggtggccggcgccaccgtcgggccagggccggttccagctccggggcgctgggtctccagctccgtccccgcgtccgaccccagcgacgggcagcggcggcggcagcagcagcagcagcagcagcagcagcagcaacagcagcctcagcagccgcaagtgctatcctcggagggcgggcagctgcggcacaacccattggacatccagatgctctcgagagggctgcacgagcaaatcttcgggcaaggaggggagatgcctggcgaggccgcggtgcgccgcagcgtcgagcacctgcagaagcacgggctctgggggcagccagccgtgcccttgcccgacgtggagctgcgcctgccgcccctctacggggacaacctggaccagcacttccgcctcctggcccagaagcagagcctgccctacctggaggcggccaacttgctgttgcaggcccagctgcccccgaagcccccggcttgggcctgggcggagggctggacccggtacggccccgagggggaggccgtacccgtggccatccccgaggagcgggccctggtgttcgacgtggaggtctgcttggcagagggaacttgccccacattggcggtggccatatccccctcggcctggtattcctggtgcagccagcggctggtggaagagcgttactcttggaccagccagctgtcgccggctgacctcatccccctggaggtccctactggtgccagcagccccacccagagagactggcaggagcagttagtggtggggcacaatgtttcctttgaccgagctcatatcagggagcagtacctgatccagggttcccgcatgcgtttcctggacaccatgagcatgcacatggccatctcagggctaagcagcttccagcgcagtctgtggatagcagccaagcagggcaaacacaaggtccagccccccacaaagcaaggccagaagtcccagaggaaagccagaagaggcccagcgatctcatcctgggactggctggacatcagcagtgtcaacagtctggcagaggtgcacagactttatgtaggggggcctcccttagagaaggagcctcgagaactgtttgtgaagggcaccatgaaggacattcgtgagaacttccaggacctgatgcagtactgtgcccaggacgtgtgggccacccatgaggttttccagcagcagctaccgctcttcttggagaggtgtccccacccagtgactctggccggcatgctggagatgggtgtctcctacctgcctgtcaaccagaactgggagcgttacctggcagaggcacagggcacttatgaggagctccagcgggagatgaagaagtcgttgatggatctggccaatgatgcctgccagctgctctcaggagagaggtacaaagaagacccctggctctgggacctggagtgggacctgcaagaatttaagcagaagaaagctaagaaggtgaagaaggaaccagccacagccagcaagttgcccatcgagggggctggggcccctggtgatcccatggatcaggaagacctcggcccctgcagtgaggaggaggagtttcaacaagatgtcatggcccgcgcctgcttgcagaagctgaaggggaccacagagctcctgcccaagcggccccagcaccttcctggacaccctggatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacagagccatcgagtccctgtacaggaagcactgtctcgaacaggggaagcagcagctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctgactgcccgtggtggccccaaggacacccagcccagctatcaccatggcaatggaccttacaacgacgtggacatccctggctgctggtttttcaagctgcctcacaaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcagctcccagatggtggtgtggctgcccaggtcagctctgccccgtgctgtgatcaggcaccccgactatgatgaggaaggcctctatggggccatcctgccccaagtggtgactgccggcaccatcactcgccgggctgtggagcccacatggctcaccgccagcaatgcccggcctgaccgagtaggcagtgagttgaaagccatggtgcaggccccacctggctacacccttgtgggtgctgatgtggactcccaagagctgtggattgcagctgtgcttggagacgcccactttgccggcatgcatggctgcacagcctttgggtggatgacactgcagggcaggaagagcaggggcactgatctacacagtaagacagccactactgtgggcatcagccgtgagcatgccaaaatcttcaactacggccgcatctatggtgctgggcagccctttgctgagcgcttactaatgcagtttaaccaccggctcacacagcaggaggcagctgagaaggcccagcagatgtacgctgccaccaagggcctccgctggtatcggctgtcggatgagggcgagtggctggtgagggagttgaacctcccagtggacaggactgagggtggctggatttccctgcaggatctgcgcaaggtccagagagaaactgcaaggaagtcacagtggaagaagtgggaggtggttgctgaacgggcatggaaggggggcacagagtcagaaatgttcaataagcttgagagcattgctacgtctgacataccacgtaccccggtgctgggctgctgcatcagccgagccctggagccctcggctgtccaggaagagtttatgaccagccgtgtgaattgggtggtacagagctctgctgttgactacttacacctcatgcttgtggccatgaagtggctgtttgaagagtttgccatagatgggcgcttctgcatcagcatccatgacgaggttcgctacctggtgcgggaggaggaccgctaccgcgctgccctggccttgcagatcaccaacctcttgaccaggtgcatgtttgcctacaagctgggtctgaatgacttgccccagtcagtcgcctttttcagtgcagtcgatattgaccggtgcctcaggaaggaagtgaccatggattgtaaaaccccttccaacccaactgggatggaaaggagatacgggattccccagggtgaagcgctggatatttaccagataattgaactcaccaaaggctccttggaaaaacgaagccagcctggaccatagcactgcctggaggctctgtatttgctcccgtggagcttcatcggggtggtgcaggctcccaaactcaggctttcagctgtgctttttgcaaaagggcttgcctaaggccagccatttttcagtagcaggacctgccaagaagattccttctaactgaaggtgcagttgaattcagtgggttcagaaccaagatgccaacatcggtgtggactacaggacaaggggcattgttgcttgttgggtaaaaatgaagcagaagccccaaagttcacattaactcaggcatttcatttattttttccttttcttcttggctggttctttgttctgtcccccatgctctgatgcagtgccctagaaggggaaagaattaatgctctaacgtgataaacctgctccaaggcagtggaaataaaaagaaggaaaaaaaa

SEQ ID NO: 167408 - DNA, 372 bp, Homo sapiens
  Payload ID: 12936
  Gene Symbol: POLG
  Gene Name: polymerase (DNA directed), gamma
  ENST ID: ENST00000530715
  CDS Start-End: 1-207
tggtttttcaagctgcctcacaaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcagccctttgctgagcgcttactaatgcagtttaaccaccggctcacacagcaggaggcagctgagaaggcccagcagatgtacgctgccaccaagggcctccgctggtatcggctgtcggatgagggcgagtggctggtgagggagttgaacctcccagtggacaggactgagggtggctggatttccc

SEQ ID NO: 167409 - DNA, 700 bp, Homo sapiens
  Payload ID: 12936
  Gene Symbol: POLG
  Gene Name: polymerase (DNA directed), gamma
  ENST ID: ENST00000526314
  CDS Start-End: 1-700
aacaagatgtcatggcccgcgcctgcttgcagaagctgaaggggaccacagagctcctgcccaagcggccccagcaccttcctggacaccctggatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacagagccatcgagtccctgtacaggaagcactgtctcgaacaggggaagcagcagctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcag

SEQ ID NO: 167410 - DNA, 1326 bp, Homo sapiens
  Payload ID: 12936
  Gene Symbol: POLG
  Gene Name: polymerase (DNA directed), gamma
  ENST ID: ENST00000530292
  CDS Start-End: 1-591
ctcacacagcaggaggcagctgagaaggcccagcagatgtacgctgccaccaagggcctccgctggtatcggctgtcggatgagggcgagtggctggtgagggagttgaacctcccagtggacaggactgagggtggctggatttccctgcaggatctgcgcaaggtccagagagaaactgcaaggaagtcacagtggaagaagtgggaggtggttgctgaacgggcatggaaggggggcacagagtcagaaatgttcaataagcttgagagcattgctacgtctgacataccacgtaccccggtgctgggctgctgcatcagccgagccctggagccctcggctgtccaggaagagtttatgaccagccgtgtgaattgggtggtacagagctctgctgttgactacttacacctcatgcttgtggccatgaagtggctgtttgaagagtttgccatagatgggcgcttctgcatcagcatccatgacgaggttcgctacctggtgcgggaggaggaccgctaccgcgctgccctggccttgcagatcaccaacctcttgaccagtaaaattcctagttcatatggatgaattaaatattaccgttccatgttgatctgccactcagaaccagtttgggaaccatgatctatcctgattattgggtgcatgtttgcctacaagctgggtctgaatgacttgccccagtcagtcgcctttttcagtgcagtcgatattgaccggtgcctcaggaaggaagtgaccatggattgtaaaaccccttccaacccaactgggatggaaaggagatacgggattccccagggtgaagcgctggatatttaccagataattgaactcaccaaaggctccttggaaaaacgaagccagcctggaccatagcactgcctggaggctctgtatttgctcccgtggagcttcatcggggtggtgcaggctcccaaactcaggctttcagctgtgctttttgcaaaagggcttgcctaaggccagccatttttcagtagcaggacctgccaagaagattccttctaactgaaggtgcagttgaattcagtgggttcagaaccaagatgccaacatcggtgtggactacaggacaaggggcattgttgcttgttgggtaaaaatgaagcagaagccccaaagttcacattaactcaggcatttcatttattttttccttttcttcttggctggttctttgttctgtcccccatgctctgatgcagtgccctagaaggggaaagaattaatgctctaacgtgataaacctgctccaaggcagtggaaataaaaagaagg

SEQ ID NO: 167411 - DNA, 524 bp, Homo sapiens
  Payload ID: 12936
  Gene Symbol: POLG
  Gene Name: polymerase (DNA directed), gamma
  ENST ID: ENST00000528881
  CDS Start-End: 1-208
ccctggctgctggtttttcaagctgcctcacaaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcagcctgaccgagtaggcagtgagttgaaagccatggtgcaggccccacctggctacacccttgtgggtgctgatgtggactcccaagagctgtggattgcagctgtgcttggagacgcccactttgccggcatgcatggctgcacagcctttgggtggatgacactgcagggcaggaagagcaggggcactgatctacacagtaagacagccactactgtgggcatcagccgtgagcatgccaaaatcttcaactacggccgcatctatggtgctgggcagccctttgctgagcgcttactaatgcagtttaaccaccggctcacacagca

SEQ ID NO: 167412 - DNA, 512 bp, Homo sapiens
  Payload ID: 12936
  Gene Symbol: POLG
  Gene Name: polymerase (DNA directed), gamma
  ENST ID: ENST00000526398
  CDS Start-End: 1-154
acttacctgggatggcttccctctgcactactcagagcgtcatggctggggctacttggtgcctgggcggcgggacaacctggccaagctgccgacaggtaccaccctggagtcagctggggtggtctgcccctacaggggaagcagcagctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctgactgcccgtggtggccccaaggacacccagcccagctatcaccatggcaatggaccttacaacgacgtggacatccctggctgctggtttttcaagctgcctcacaaggatggtaatagctgtaatgtgggaagcccctttgccaaggacttcctgcccaagatggaggatggcaccctgcaggctggcccaggaggtgccagtgg

SEQ ID NO: 167413 - DNA, 4668 bp, Homo sapiens
  Payload ID: 12936
  Gene Symbol: POLG
  Gene Name: polymerase (DNA directed), gamma
  ENST ID: ENST00000631044
  CDS Start-End: 305-1078
ggaagttgcggctgccagcgaagcggaccggccgggtggaggccacacgctaccccgaggctgcgtaggccgcgcgaagggggacgccgtgccgtgggcctggggtcgggggagcagcagaccgggaagcaccgtgaggaccgaggatttggggtggaaggcaggcatggtcaaacccatttcactgacaggagagcagagacaggacgtgtctctctccacgtcttccagccagtaaaagaagccaagctggagcccaaagccaggtgttctgactcccagcgtgggggtccctgcaccaaccatgagccgcctgctctggaggaaggtggccggcgccaccgtcgggccagggccggttccagctccggggcgctgggtctccagctccgtccccgcgtccgaccccagcgacgggcagcggcggcggcagcagcagcagcagcagcagcagcagcagcaacagcagcctcagcagccgcaagtgctatcctcggagggcgggcagctgcggcacaacccattggacatccagatgctctcgagagggctgcacgagcaaatcttcgggcaaggaggggagatgcctggcgaggccgcggtgcgccgcagcgtcgagcacctgcagaagcacgggctctgggggcagccagccgtgcccttgcccgacgtggagctgcgcctgccgcccctctacggggacaacctggaccagcacttccgcctcctggcccagaagcagagcctgccctacctggaggcggccaacttgctgttgcaggcccagctgcccccgaagcccccggcttgggcctgggcggagggctggacccggtacggccccgagggggaggccgtacccgtggccatccccgaggagcgggccctggtgttcgacgtggaggtctgcttggcagagggaacttgccccacattggcggtggccatatccccctcggcctggattaaaatactatttacaaccttaatgctttcaggcatggccagcaaaaaagttggcagtttctttattcctattggaagctacatctttgtaaagaaagctgcgaaatgttaaatatgcagttgaaaatggtgaaaacatggctaaatagataaggtattcctggtgcagccagcggctggtggaagagcgttactcttggaccagccagctgtcgccggctgacctcatccccctggaggtccctactggtgccagcagccccacccagagagactggcaggagcagttagtggtggggcacaatgtttcctttgaccgagctcatatcagggagcagtacctgatccagggttcccgcatgcgtttcctggacaccatgagcatgcacatggccatctcagggctaagcagcttccagcgcagtctgtggatagcagccaagcagggcaaacacaaggtccagccccccacaaagcaaggccagaagtcccagaggaaagccagaagaggcccagcgatctcatcctgggactggctggacatcagcagtgtcaacagtctggcagaggtgcacagactttatgtaggggggcctcccttagagaaggagcctcgagaactgtttgtgaagggcaccatgaaggacattcgtgagaacttccaggacctgatgcagtactgtgcccaggacgtgtgggccacccatgaggttttccagcagcagctaccgctcttcttggagaggtgtccccacccagtgactctggccggcatgctggagatgggtgtctcctacctgcctgtcaaccagaactgggagcgttacctggcagaggcacagggcacttatgaggagctccagcgggagatgaagaagtcgttgatggatctggccaatgatgcctgccagctgctctcaggagagaggtacaaagaagacccctggctctgggacctggagtgggacctgcaagaatttaagcagaagaaagctaagaaggtgaagaaggaaccagccacagccagcaagttgcccatcgagggggctggggcccctggtgatcccatggatcaggaagacctcggcccctgcagtgaggaggaggagtttcaacaagatgtcatggcccgcgcctgcttgcagaagctgaaggggaccacagagctcctgcccaagcggccccagcaccttcctggacaccctggatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacagagccatcgagtccctgtacaggaagcactgtctcgaacaggggaagcagcagctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctggtgctggagcagggcctgatataggtgtgtggccctcacagactgcccgtggtggccccaaggacacccagcccagctatcaccatggcaatggaccttacaacgacgtggacatccctggctgctggtttttcaagctgcctcacaaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcagctcccagatggtggtgtggctgcccaggtcagctctgccccgtgctgtgatcaggcaccccgactatgatgaggaaggcctctatggggccatcctgccccaagtggtgactgccggcaccatcactcgccgggctgtggagcccacatggctcaccgccagcaatgcccggcctgaccgagtaggcagtgagttgaaagccatggtgcaggccccacctggctacacccttgtgggtgctgatgtggactcccaagagctgtggattgcagctgtgcttggagacgcccactttgccggcatgcatggctgcacagcctttgggtggatgacactgcagggcaggaagagcaggggcactgatctacacagtaagacagccactactgtgggcatcagccgtgagcatgccaaaatcttcaactacggccgcatctatggtgctgggcagccctttgctgagcgcttactaatgcagtttaaccaccggctcacacagcaggaggcagctgagaaggcccagcagatgtacgctgccaccaagggcctccgctggtatcggctgtcggatgagggcgagtggctggtgagggagttgaacctcccagtggacaggactgagggtggctggatttccctgcaggatctgcgcaaggtccagagagaaactgcaaggaagtcacagtggaagaagtgggaggtggttgctgaacgggcatggaaggggggcacagagtcagaaatgttcaataagcttgagagcattgctacgtctgacataccacgtaccccggtgctgggctgctgcatcagccgagccctggagccctcggctgtccaggaagagtttatgaccagccgtgtgaattgggtggtacagagctctgctgttgactacttacacctcatgcttgtggccatgaagtggctgtttgaagagtttgccatagatgggcgcttctgcatcagcatccatgacgaggttcgctacctggtgcgggaggaggaccgctaccgcgctgccctggccttgcagatcaccaacctcttgaccaggtgcatgtttgcctacaagctgggtctgaatgacttgccccagtcagtcgcctttttcagtgcagtcgatattgaccggtgcctcaggaaggaagtgaccatggattgtaaaaccccttccaacccaactgggatggaaaggagatacgggattccccagggtgaagcgctggatatttaccagataattgaactcaccaaaggctccttggaaaaacgaagccagcctggaccatagcactgcctggaggctctgtatttgctcccgtggagcttcatcggggtggtgcaggctcccaaactcaggctttcagctgtgctttttgcaaaagggcttgcctaaggccagccatttttcagtagcaggacctgccaagaagattccttctaactgaaggtgcagttgaattcagtgggttcagaaccaagatgccaacatcggtgtggactacaggacaaggggcattgttgcttgttgggtaaaaatgaagcagaagccccaaagttcacattaactcaggcatttcatttattttttccttttcttcttggctggttctttgttctgtcccccatgctctgatgcagtgccctagaaggggaaagaattaatgctctaacgtgataaacctgctccaaggcagtggaaataaaaagaaggaaaaaaaagactctatcttctca

SEQ ID NO: 167414 - DNA, 1564 bp, Homo sapiens
  Payload ID: 12937
  Gene Symbol: POLG2
  Gene Name: polymerase (DNA directed), gamma 2, accessory subunit
  Uniprot ID: Q9UHN1
  ENST ID: ENST00000539111
  CDS Start-End: 69-1526
aacggtagtggtggcttgttgggatccgttgagtgatgggagagtgtgctctttaacttcggagagagatgcgctctcgtgtagccgtcagggcctgccataaggtctgcaggtgcctgttgtctgggtttgggggtcgagtagatgcggggcagccggagctgttgacggaaaggagtagccccaaaggagggcatgtgaagtcgcacgcggagctcgaggggaacggcgagcacccagaagcccccgggtctggagagggaagcgaggcgctgttagagatctgtcagagaaggcatttcctaagtggaagcaagcagcagcttagccgggattctcttctgagtgggtgccaccccggcttcggacccttgggcgtagagttgcggaagaacctggccgcagaatggtggacctcggtggtggtgttcagggagcaggtattcccggtggacgccctccaccacaaaccaggccctttgctacccggggacagtgccttcaggttagtttctgcagaaactctacgcgaaatcttgcaagacaaagagctgagtaaggaacagctagtagcatttcttgagaacgtattaaaaacttctgggaaactacgggagaaccttcttcacggtgccttggaacactatgttaattgcctggatctggtaaacaagaggctaccttatggccttgctcagattggagtgtgttttcatcctgtttttgacactaagcagatacgaaatggtgttaaaagtattggtgagaagactgaagcttcgttagtatggtttactcctccgagaacttcaaaccagtggcttgatttctggttacgtcatcgactccagtggtggagaaagtttgccatgagtccatctaacttcagcagcagtgactgtcaggatgaagaaggccggaaaggaaacaaactttactacaattttccctggggaaaggagttaatagaaaccctgtggaacctaggagatcacgaacttttacacatgtatcctggcaatgtgtctaaattacatggccgagatggacgaaaaaatgtggttccttgtgttctctctgtaaatggggacctagaccgaggcatgctggcctacctctatgattctttccagctgacagagaactcctttacaagaaagaaaaatcttcatagaaaggtacttaaacttcacccttgtttagcccctattaaggttgctttggatgtaggaagaggccccacattggaactaagacaggtttgtcaagggctatttaatgagttactagaaaatgggatttctgtgtggcctggttatttggaaactatgcagtcctcattggaacaactttattcgaagtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatagatttttatatttgtataataaatattcttctctcctaa

SEQ ID NO: 167415 - DNA, 652 bp, Homo sapiens
  Payload ID: 12937
  Gene Symbol: POLG2
  Gene Name: polymerase (DNA directed), gamma 2, accessory subunit
  ENST ID: ENST00000581355
  CDS Start-End: 1-456
tcaaaccagtggcttgatttctggttacgtcatcgactccagtggtggagaaagtttgccatgagtccatctaacttcagcagcagtgactgtcaggatgaagaaggccggaaaggaaacaaactttactacaattttccctggggaaaggagttaatagaaaccctgtggaacctaggagatcacgaacttttacacatgtatcctggcaatgtgtctaaattacatggccgagatggacgaaaaaatgtggttccttgtgttctctctgtaaatggggacctagaccgaggcatgctggcctacctctatgattctttccagctgacagagaactcctttacaagaaagaaaaatcttcatagaaaggtacttaaacttcacccttgtttagcccctattaaggttgctttggatgtaggaagaggccccacattggaactaagacaggtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatagatttttatatttgtataataaatattcttctctcct

SEQ ID NO: 167416 - DNA, 565 bp, Homo sapiens
  Payload ID: 12937
  Gene Symbol: POLG2
  Gene Name: polymerase (DNA directed), gamma 2, accessory subunit
  ENST ID: ENST00000578997
  CDS Start-End: 1-246
atctgtcagagaaggcatttcctaagtggaagcaagcagcagcttagccgggattctcttctgagtgggtgccaccccggcttcggacccttgggcgtagagttgcggaagaacctggccgcagaatggtggacctcggtggtggtgttcagggagcaggtattcccggtggacgccctccaccacaaaccaggccctttgctacccggggacagtgccttcaggtgccttggaacactatgttaattgcctggatctggtaaacaagaggctaccttatggccttgctcagattggagtgtgttttcatcctgtttttgacactaagcagatacgaaatggtgttaaaagtattggtgagaagactgaagcttcgttagtatggtttactcctccgagaacttcaaaccagtggcttgatttctggttacgtcatcgactccagtggtggagaaagtttgccatgagtccatctaacttcagcagcagtgactgtcaggatgaagaaggccggaaaggaaacaaactttactacaattttccctggggaaaggagttaatagaa

SEQ ID NO: 167417 - DNA, 2670 bp, Homo sapiens
  Payload ID: 12938
  Gene Symbol: POLL
  Gene Name: polymerase (DNA directed), lambda
  Uniprot ID: Q9UGP5
  ENST ID: ENST00000299206
  CDS Start-End: 372-2099
ctgctggtaagtggtctattcctgcccacccccgggtgactagcttggccagtagtcgaccccacccggggaccgactctgggggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattgaa

SEQ ID NO: 167418 - DNA, 2289 bp, Homo sapiens
  Payload ID: 12938
  Gene Symbol: POLL
  Gene Name: polymerase (DNA directed), lambda
  ENST ID: ENST00000339310
  CDS Start-End: 822-1718
ggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacaggtgcagggcgttcccactcacccccgaaagtcctcctccttcctctgcgagtctgtgttggaggtagagaaatagtatgtggggtttatgtgcaggtcctccccaggctccgctccatcccctaaagctccatttcctagcccagcatcccatttggtaaagcccttcgaagtgggccgcagcagggctgtgctgaatctttagcgcaacccctctgaggaatggtgtcgtttcctactcctcaaaagtacccccgatggcaccagccttcccctcatttcccgtaatactccaacttcgaaaggctggggagtgtgaagctaggctaaaccactgaagtttaaccgggtttgaagagaccccctcccccgacccgcttccccaaactgggctgctacccccaaagcctggtcaggaaagaccctacctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattgaa

SEQ ID NO: 167419 - DNA, 2792 bp, Homo sapiens
  Payload ID: 12938
  Gene Symbol: POLL
  Gene Name: polymerase (DNA directed), lambda
  Uniprot ID: Q9UGP5
  ENST ID: ENST00000370162
  CDS Start-End: 496-2223
tgactcggaagctattctggccatttgccctccttccccccttcgtccgctctcattggctctgctggtaagtggtctattcctgcccacccccgggtgactagcttggccagtagtcgaccccacccggggaccgactctgggggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacaggtgcagggcgttcccactcacccccgaaagtcctcctccttcctctgcgagtctgtgttggagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattg

SEQ ID NO: 167420 - DNA, 1536 bp, Homo sapiens
  Payload ID: 12938
  Gene Symbol: POLL
  Gene Name: polymerase (DNA directed), lambda
  ENST ID: ENST00000370168
  CDS Start-End: 219-965
cctggctctgcccacaatcaccagggcagcttggtaaggatgaagatgacaaggtccatcctcagactgatggaatcatgaacgagcatcttaggatagtggcagggctggatgatggcatgtttcccatgctccctgcctttcccaagtcctgctgagtacagacccaactgcccctaggttggtcctgcctctagccttccctagagtctggggcgatggaagccttgtgtgtgtgctcactcatgcctcttcattggtcctggatccttacagcttcccatctggctgcttttttccagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattgaa

SEQ ID NO: 167421 - DNA, 2360 bp, Homo sapiens
  Payload ID: 12938
  Gene Symbol: POLL
  Gene Name: polymerase (DNA directed), lambda
  Uniprot ID: Q9UGP5
  ENST ID: ENST00000370169
  CDS Start-End: 62-1789
gatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattgaa

SEQ ID NO: 167422 - DNA, 2308 bp, Homo sapiens
  Payload ID: 12938
  Gene Symbol: POLL
  Gene Name: polymerase (DNA directed), lambda
  ENST ID: ENST00000370172
  CDS Start-End: 274-1737
atttgccctccttccccccttcgtccgctctcattggctctgctgccttcatgtgcttcagccctacgttgtttatgtccagaatcagatattggagctgactctgcctgtccagggcctgcagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattgaa

SEQ ID NO: 167423 - DNA, 683 bp, Homo sapiens
  Payload ID: 12938
  Gene Symbol: POLL
  Gene Name: polymerase (DNA directed), lambda
  ENST ID: ENST00000454524
  CDS Start-End: 229-683
ccttcatgtgcttcagccctacgttgtttatgtccagaatcagatattggagctgactctgcctgtccagggcctgcagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacc

SEQ ID NO: 167424 - DNA, 855 bp, Homo sapiens
  Payload ID: 12938
  Gene Symbol: POLL
  Gene Name: polymerase (DNA directed), lambda
  ENST ID: ENST00000413344
  CDS Start-End: 50-855
cttcgtccgctctcattggctctgctggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgt

SEQ ID NO: 167425 - DNA, 1457 bp, Homo sapiens
  Payload ID: 12938
  Gene Symbol: POLL
  Gene Name: polymerase (DNA directed), lambda
  ENST ID: ENST00000415897
  CDS Start-End: 47-1457
cagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagcagtcccctctgttgggccagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactg

SEQ ID NO: 167426 - DNA, 784 bp, Homo sapiens
  Payload ID: 12938
  Gene Symbol: POLL
  Gene Name: polymerase (DNA directed), lambda
  ENST ID: ENST00000429502
  CDS Start-End: 131-784
cccttcgtccgctctcattggctctgctgcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccc

SEQ ID NO: 167427 - DNA, 1049 bp, Homo sapiens
  Payload ID: 12938
  Gene Symbol: POLL
  Gene Name: polymerase (DNA directed), lambda
  ENST ID: ENST00000426919
  CDS Start-End: 46-1049
agccctgaccaacgctccaataggccgggatccagccatacttcaatggatcccaggggtatcttgaaggcatttcccaagcggcagaaaattcatgctgatgcatcatcaaaaccttcatgtgcttcagccctacgttgtttatgtccagaatcagatattggagctgactctgcctgtccagggcctgcagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaa

SEQ ID NO: 167428 - DNA, 1022 bp, Homo sapiens
  Payload ID: 12938
  Gene Symbol: POLL
  Gene Name: polymerase (DNA directed), lambda
  ENST ID: ENST00000430045
  CDS Start-End: 458-1022
cccttcgtccgctctcattggctctgctggtaagtggtctattcctgcccacccccgggtgactagcttggccagtagtcgaccccacccggggaccgactctgggggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacaggtgcagggcgttcccactcacccccgaaagtcctcctccttcctctgcgagtctgtgttggagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacaccc

SEQ ID NO: 167429 - DNA, 1953 bp, Homo sapiens
  Payload ID: 12938
  Gene Symbol: POLL
  Gene Name: polymerase (DNA directed), lambda
  Uniprot ID: Q9UGP5
  ENST ID: ENST00000628479
  CDS Start-End: 482-1384
tgactcggaagctattctggccatttgccctccttccccccttcgtccgctctcattggctctgctggtaagtggtctattcctgcccacccccgggtgactagcttggccagtagtcgaccccacccggggaccgactctgggggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattg

SEQ ID NO: 167430 - DNA, 2631 bp, Homo sapiens
  Payload ID: 12939
  Gene Symbol: POLM
  Gene Name: polymerase (DNA directed), mu
  Uniprot ID: Q9NP87
  ENST ID: ENST00000242248
  CDS Start-End: 103-1587
ccgcccgcccacccgcttccgtcagcctcactggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagaggtaccagaccatgaagctcttcacccagatcttcggggtcggtgtgaagactgctgaccggtggtaccgggaaggactgcgaaccttagatgacctccgagagcagccccagaaactaacccaacagcagaaagcggggctccagcaccaccaggacctgagcaccccagtcctgcggtccgatgtagatgccctgcagcaggtggtggaggaagctgtggggcaggccctgcctggggccaccgtcacgctgaccggcggcttccgcagggggaagttgcagggccatgacgtggacttcctcatcacccaccccaaggagggtcaggaggcggggctgctgcctagagtgatgtgccgcctgcaggaccagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaacatgcagtaaa

SEQ ID NO: 167431 - DNA, 2444 bp, Homo sapiens
  Payload ID: 12939
  Gene Symbol: POLM
  Gene Name: polymerase (DNA directed), mu
  Uniprot ID: Q9NP87
  ENST ID: ENST00000335195
  CDS Start-End: 27-1400
ccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagaggtaccagaccatgaagctcttcacccagatcttcggggtcggtgtgaagactgctgaccggtggtaccgggaaggactgcgaaccttagatgacctccgagagcagccccagaaactaacccaacagcagaaagcggcaccaccaggacctgagcaccccagtcctgcggtccgatgtagatgccctgcagcaggtggtggaggaagctgtggggcaggccctgcctggggccaccgtcacgctgaccggcggcttccgcagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaacatgcagtaaa

SEQ ID NO: 167432 - DNA, 2380 bp, Homo sapiens
  Payload ID: 12939
  Gene Symbol: POLM
  Gene Name: polymerase (DNA directed), mu
  Uniprot ID: Q9NP87
  ENST ID: ENST00000395831
  CDS Start-End: 48-1574
gagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagagggctccagcaccaccaggacctgagcaccccagtcctgcggtccgatgtagatgccctgcagcaggtggtggaggaagctgtggggcaggccctgcctggggccaccgtcacgctgaccggcggcttccgcagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagggaagcagcagtggcaagactcctaggtcacggaagtcctgcttctgttgcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaaca

SEQ ID NO: 167433 - DNA, 2404 bp, Homo sapiens
  Payload ID: 12939
  Gene Symbol: POLM
  Gene Name: polymerase (DNA directed), mu
  ENST ID: ENST00000435068
  CDS Start-End: 53-520
gctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggagctgctggagcatggagtgtgtgaggaggtggagagagttcggcgctcagagaggtaccagaccatgaagggctccagcaccaccaggacctgagcaccccagtcctgcggtccgatgtagatgccctgcagcaggtggtggaggaagctgtggggcaggccctgcctggggccaccgtcacgctgaccggcggcttccgcaggtaagaaggcccgacgtgcccctctggcttggcttcagacccctccccagtgaagggacctgagtcggggaccctgaagcgggcccactcgttggaagggatgtggcctggggctggagtgagcaggccgtgtccctgagtcagagtcagactgacgccctcagggggaagttgcagggccatgacgtggacttcctcatcacccaccccaaggagggtcaggaggcggggctgctgcctagagtgatgtgccgcctgcaggaccagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagggaagcagcagtggcaagactcctaggtcacggaagtcctgcttctgttgcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaacatgcagt

SEQ ID NO: 167434 - DNA, 550 bp, Homo sapiens
  Payload ID: 12939
  Gene Symbol: POLM
  Gene Name: polymerase (DNA directed), mu
  ENST ID: ENST00000414235
  CDS Start-End: 74-550
actggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggaggctctggagatactggccgaggcagcaggctttgaaggcagtgagggccgcctcctcaccttctgcagagcagcctcggtgctcaaggcccttcccagccct

SEQ ID NO: 167435 - DNA, 1174 bp, Homo sapiens
  Payload ID: 12939
  Gene Symbol: POLM
  Gene Name: polymerase (DNA directed), mu
  ENST ID: ENST00000434229
  CDS Start-End: 46-747
gtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggagctgctggagcatggagtgtgtgaggaggtggagagagttcggcgctcagagaggtaccagaccatgaagctcttcacccagatcttcggggtcggtgtgaagactgctgaccggtggtaccgggaaggactgcgaaccttagatgacctccgagagcagccccagaaactaacccaacagcagaaagcggggctccagcaccaccaggacctgagcaccccagtcctgcggtccgatgtagatgccctgcagcaggtggtggaggaagctgtggggcaggccctgcctggggccaccgtcacgctgaccggcggcttccgcaggtaagaaggcccgacgtgcccctctggcttggcttcagacccctccccagtgaagggacctgagtcggggaccctgaagcgggcccactcgttggaagggatgtggcctggggctggagtgagcaggccgtgtccctgagtcagagtcagactgacgccctcagggggaagttgcagggccatgacgtggacttcctcatcacccaccccaaggagggtcaggaggcggggctgctgcctagagtgatgtgccgcctgcaggaccagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctg

SEQ ID NO: 167436 - DNA, 2561 bp, Homo sapiens
  Payload ID: 12939
  Gene Symbol: POLM
  Gene Name: polymerase (DNA directed), mu
  ENST ID: ENST00000430942
  CDS Start-End: 77-805
ctcactggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagagctcttcacccagatcttcggggtcggtgtgaagactgctgaccggtggtaccgggaaggactgcgaaccttagatgacctccgagagcagccccagaaactaacccaacagcagaaagcggggctccagcaccaccaggacctgagcaccccagtcctgcggtccgatgtagatgccctgcagcaggtggtggaggaagctgtggggcaggccctgcctggggccaccgtcacgctgaccggcggcttccgcagggccatgacgtggacttcctcatcacccaccccaaggagggtcaggaggcggggctgctgcctagagtgatgtgccgcctgcaggaccagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttg

SEQ ID NO: 167437 - DNA, 811 bp, Homo sapiens
  Payload ID: 12939
  Gene Symbol: POLM
  Gene Name: polymerase (DNA directed), mu
  ENST ID: ENST00000445616
  CDS Start-End: 63-569
cttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggcctttcttcctcaccaagtagatgacacagcaactccgagcgggatgacccatgggttagcaggagcctgtcctctggatgctataaggctcccggcctctgacaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccag

SEQ ID NO: 167438 - DNA, 587 bp, Homo sapiens
  Payload ID: 12939
  Gene Symbol: POLM
  Gene Name: polymerase (DNA directed), mu
  ENST ID: ENST00000452049
  CDS Start-End: 93-587
acccgcttccgtcagcctcactggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccggcccctccctgcaggaggctctg

SEQ ID NO: 167439 - DNA, 546 bp, Homo sapiens
  Payload ID: 12939
  Gene Symbol: POLM
  Gene Name: polymerase (DNA directed), mu
  ENST ID: ENST00000418926
  CDS Start-End: 1-406
atggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagaggtaccagaccatgaaggtgcgcagggcagggctcggacctaccccaggaatgtcctgccctgggaatgacaacacagtccacaccatgcacggggaggcaaacaggggcagctgacccagcccaggggtcagagaaggtcttgccgaggaagtggcagctaagctgatacctgatatgcacaaggcagccaagtggagacagctcttcacccagatcttcggggtcggtgtgaagactgctgaccggtggtaccg

SEQ ID NO: 167440 - DNA, 3218 bp, Homo sapiens
  Payload ID: 12939
  Gene Symbol: POLM
  Gene Name: polymerase (DNA directed), mu
  ENST ID: ENST00000458246
  CDS Start-End: 74-886
actggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagaggtaccagaccatgaaggtgcgcagggcagggctcggacctaccccaggaatgtcctgccctgggaatgacaacacagtccacaccatgcacggggaggcaaacaggggcagctgacccagcccaggggtcagagaaggtcttgccgaggaagtggcagctaagctgatacctgatatgcacaaggcagccaagtggagacaggctggagtacagtggtgcgatcacagctcacggcagccttgacttcctgggctcaaaccatcctcccacctcagtctctggagtagctgggactacaggcatgtgccaccacaccagctcttcacccagatcttcggggtcggtgtgaagactgctgaccggtggtaccgggaaggactgcgaaccttagatgacctccgagagcagccccagaaactaacccaacagcagaaagcggggctccagcaccaccaggacctgagcaccccagtcctgcggtccgatgtagatgccctgcagcaggtggtggaggaagctgtggggcaggccctgcctggggccaccgtcacgctgaccggcggcttccgcaggtaagaaggcccgacgtgcccctctggcttggcttcagacccctccccagtgaagggacctgagtcggggaccctgaagcgggcccactcgttggaagggatgtggcctggggctggagtgagcaggccgtgtccctgagtcagagtcagactgacgccctcagggggaagttgcagggccatgacgtggacttcctcatcacccaccccaaggagggtcaggaggcggggctgctgcctagagtgatgtgccgcctgcaggaccaggtgagggcctccctgctccccaagagccaccgctggccaatgccactgcctcctgctctctccacaccaccggatggtctcagccacgcccgcctctccccacagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagggaagcagcagtggcaagactcctaggtcacggaagtcctgcttctgttgcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaaca

SEQ ID NO: 167441 - DNA, 8775 bp, Homo sapiens
  Payload ID: 12940
  Gene Symbol: POLQ
  Gene Name: polymerase (DNA directed), theta
  Uniprot ID: O75417
  ENST ID: ENST00000264233
  CDS Start-End: 130-7902
gggcgggccgggaggtttgagtttgaagactggcgggaagatgtccgcagctgttgccaggccagggttctcccgagagggaggacgctgggactgtggcttgccctgatcggccgagaagagtttgccatgaatcttctgcgtcggagtgggaaacggcggcgttcagaatcaggctcagattcgttctcgggaagcggcggtgacagcagtgccagcccccagttcctctccgggtccgtgctgagcccgccgcccggccttggtcgctgcctgaaggccgcagctgcaggagaatgcaagcctacagttcctgactacgaaagagacaagctactattggcaaactggggacttcctaaagcagttctggaaaaataccacagttttggtgtaaaaaagatgtttgaatggcaggcagagtgccttttgcttggacaagtcctggaaggaaagaatttagtttattcagctcctacaagtgctgggaagactcttgtggcagaattacttattttgaagcgggttttggaaatgcggaagaaagctttgtttattcttccctttgtttctgtggctaaagagaagaaatactacctccagagtctgtttcaggaagtaggaataaaagtagacggttatatgggcagcacctctccatcaaggcatttctcttcattggatattgcagtctgcacaattgagagagccaatggtctgatcaatcgcctcatagaggaaaataagatggatctgttaggaatggtggttgtggatgaattacatatgctgggagactctcaccgagggtatctgctggaacttttgctgaccaagatttgctatattactcggaaatcagcatcttgtcaggcagatctagccagttctctgtctaatgctgtgcaaatcgttggcatgagtgctacccttcctaatttggagcttgtggcttcctggttgaatgctgaactctaccataccgactttcgccctgtaccgcttttggagtcagtaaaagttggaaattccatatatgactcttcaatgaaacttgtgagggaatttgagcccatgctacaagtgaagggagatgaggaccatgttgttagtttatgttatgagacgatttgtgataaccattcagtattacttttttgtccatcaaagaaatggtgtgagaagctggcagatatcattgctcgagagttttataatctacatcatcaagctgagggattggtgaaaccctctgaatgcccaccagtaattctggaacaaaaagaactcctggaagtgatggatcagttaagacgtttgccttcaggactggactctgtattacagaaaactgtaccatggggagtagcatttcatcatgcaggtcttacttttgaggagagggatatcattgaaggagcctttcgtcaaggtctcattcgggtcttggcggcaacttctactctttcttctggggtgaatttacctgcacgtcgtgtgattattcgaacccctatttttggtggtcgacctctagatattcttacttataagcagatggttggccgtgctggcaggaaaggagtggacacagtaggcgagagtatcttaatttgtaagaactctgagaaatcaaaaggcatagctctccttcagggttctctaaagcctgttcgcagctgtctgcaaagacgagaaggagaagaagtaactggcagcatgatacgagctattctggagataatagttggtggagtggcaagtacatcacaagatatgcatacttatgctgcctgcacatttttggctgcaagtatgaaagaagggaagcaaggaattcagagaaatcaagagtctgttcagcttggagcgattgaggcctgtgtgatgtggctactagaaaatgaattcatccagagtacagaagccagtgatggaacagaaggaaaggtgtatcatccaacacatcttggttcggccactctttcttcttcactttctccagctgatactttagatatttttgctgacctgcaaagagcaatgaagggctttgttttagagaatgatcttcatattctctatctggttacacctatgtttgaggattggactactattgattggtatcgatttttctgtttatgggagaagttgccaacttcaatgaaaagggtggcagagctagtgggagttgaagaggggttcttggcccgttgtgtgaaaggaaaagtagtagccagaactgagagacagcatcgacaaatggccatccataaaaggtttttcaccagtcttgtgctattagatttaatcagtgaagttcccttaagggaaataaatcagaaatatggatgcaatcgtgggcagattcaatctttgcaacagtcagctgctgtttatgcagggatgattacagtattttccaaccgtctgggctggcacaacatggaactactactttcccaatttcagaagcgtcttacgtttggcatccagagggagctgtgtgacctggttcgggtatccttactaaatgctcagagagccagggttctctatgcttctggctttcatactgtggcagaccttgctagagcaaatattgtggaggtggaggtgattctgaaaaatgctgtgcctttcaaaagtgcccggaaggcagtggatgaggaagaggaagcagttgaagaacgtcgcaatatgcgaactatctgggtgactggcagaaaaggtttaactgaaagggaagcagcagcccttatagtggaagaagccagaatgattctgcagcaggacttagttgaaatgggagtgcaatggaatccatgtgccctgttacattctagtacatgctcattgactcatagtgagtccgaagtaaaggaacacacatttatatcccaaactaagagttcttataaaaaattaacatcaaagaacaaaagtaacacaatatttagtgattcttatattaagcattcaccaaatatagtgcaagacttaaataaaagtagagagcatacaagttcctttaattgtaatttccagaatgggaatcaagaacatcagacatgttccattttcagagcaagaaaacgggcctctttagatataaataaagagaagccaggagcctctcagaatgaggggaaaacaagtgataagaaagttgttcagactttttcacagaaaacaaaaaaggcacctttgaatttcaattcagaaaagatgagcagaagttttcgatcttggaaacgtagaaagcatctaaagcgatctagggacagcagccccctgaaagactctggagcgtgtagaatccatttacaaggacagactctgtctaatcctagtctttgtgaagacccgtttaccttagatgagaagaaaacggaatttagaaattcagggccatttgctaaaaatgtatctttgagtggtaaggaaaaagataataaaacatcattcccattacaaataaagcaaaattgttcatggaacataacactaactaatgataattttgtggagcatattgtcacaggatctcagagtaaaaatgtgacttgtcaggccactagtgtggttagtgaaaagggcagaggagtagctgttgaggcagaaaaaataaatgaagtgctgatacaaaatggttcaaaaaaccagaatgtttatatgaaacaccatgacatccatccaattaaccagtacctgcgaaagcaatctcatgaacagacaagcactattaccaaacagaaaaatataatagagagacaaatgccctgtgaagcagtcagtagttacataaatagagactcaaatgttactatcaattgtgaaaggataaagcttaatacagaggaaaataaaccaagtcattttcaggcattaggagatgatataagcagaactgtgatacccagtgaagtacttccatcagctggagcatttagcaaatcagaaggccagcatgagaattttctaaatatttctagactacaagaaaaaacaggtacttatacaacaaacaaaactaaaaataatcatgtttctgacttaggtttagtcctctgtgattttgaagatagtttctatctggatactcagtcagagaaaataatacaacagatggcaactgaaaatgccaaactaggagcaaaggacaccaacctggcagcagggataatgcagaagagcttagtccaacagaactcaatgaactcttttcagaaggagtgtcacattccttttcctgctgaacagcaccctctaggagcgactaagatagatcatttggaccttaagactgtaggtactatgaaacaaagcagtgattcacatggggttgatatcctgactccagaaagcccgattttccattctccaatactattggaggaaaatggtctttttttaaaaaagaatgaagtttctgttactgattcacaattaaatagttttcttcaaggttatcaaacacaagaaactgtgaaaccagttatacttctgattcctcaaaagagaactcccactggtgtagaaggagaatgtcttccagttcctgaaacaagtttgaatatgagtgatagtttactatttgatagcttcagtgatgactatctagtaaaagaacaattacctgatatgcaaatgaaagaaccccttccttcagaagtaacatcaaaccattttagtgattctctgtgtctacaagaagacctaattaaaaaatcaaatgtaaatgagaatcaagatacccaccagcagttgacttgttccaatgatgaatctattatattttcagaaatggattctgttcagatggttgaagctttggacaatgtggatatatttcctgtccaagagaagaatcatactgtagtatctcctagagcattagaactaagtgatccagtacttgatgagcaccaccaaggtgatcaagatggaggagatcaagatgaaagggctgaaaaatcaaaattaactgggaccaggcaaaatcattcattcatatggtcaggggcatcatttgatctaagtccaggactgcaaaggattttagataaagtatccagtcctctagaaaatgaaaagctaaaatcaatgactataaacttttccagtttgaatagaaaaaatacagagttaaatgaagaacaagaagttatttcaaacttggagacaaaacaagtgcagggaatttcattttcttctaataatgaagtaaaaagcaagattgagatgctagaaaacaatgccaatcatgatgaaacctcatccctcttacctcgtaaagaaagtaatatagttgatgataatggtctcattcctcctacacccattccaacatctgcttctaagctgacatttccagggattcttgaaacacctgtaaacccttggaaaactaataatgttttacaacctggtgaaagttatttatttggctcaccttcagatattaaaaaccacgatttaagtccagggagtagaaatgggttcaaagacaacagccctattagtgacacaagcttttcacttcagttatcacaggatggattacagttaactccagcctcaagcagttcagaaagtttgtccataattgatgtagcaagtgaccaaaatcttttccaaacattcattaaggagtggcggtgcaaaaagcgattttccatctcactggcttgtgaaaagattagaagtttgacatcttctaaaactgctactattggcagtaggtttaagcaagctagctcacctcaggaaattcctattagagatgatggatttcccattaaaggttgtgatgacaccttggtggttggactggcagtatgctggggtggaagggatgcctattatttttcactgcagaaggaacaaaagcattctgaaattagtgccagtttggttccaccttctttagatccaagcctgactttgaaagacaggatgtggtaccttcaatcttgcttgcgaaaggaatctgataaagaatgttctgttgtcatctatgacttcatccagagctataaaattcttcttctttcttgtggcatctccttggagcaaagttatgaagatcctaaggtggcatgctggttactagatccagattctcaggagccgactcttcatagcatagttaccagttttcttcctcatgagcttccactcctagaagggatggagaccagccaagggattcaaagcctggggctaaatgctggcagtgagcattctgggcgatacagagcatctgtggagtccattctcatcttcaactctatgaatcagctcaactctttgttgcagaaggaaaaccttcaagatgttttccgtaaggtggaaatgccctctcagtactgcttggccttgctagaactaaatggaattggctttagtactgcagaatgtgaaagtcagaaacatataatgcaagccaagctggatgcaattgagacccaggcctatcaactagctggccacagtttttctttcaccagttcagatgacatcgctgaggttttatttttggaattgaagttgcccccaaatagagagatgaaaaaccaaggcagcaagaaaactctgggttctaccagaagagggattgacaatggacgcaagctaaggctgggaagacagttcagcactagtaaggacgttttaaataaattaaaggcattacatcctttaccaggcttgatattagaatggagaagaatcactaatgctattaccaaagtggtctttccccttcagcgggaaaagtgtcttaatccttttcttggaatggaaagaatctatcctgtatcacagtcgcacactgctacaggacgaataacctttacagaaccaaatattcagaatgtgccaagagattttgaaatcaaaatgccaacactagtaggagaaagcccaccttctcaagctgtaggcaaaggcctacttcccatgggcagaggaaaatataagaagggtttcagcgtgaatcctagatgccaggcacagatggaggagagagctgcagacagaggaatgccattttcaattagcatgcgacatgcctttgtgcctttcccaggtggttcaatactggctgctgactactctcagcttgaactgaggatcttggctcatttatcccatgatcgtcgtctcattcaagtgttaaacactggagctgatgttttcaggagcattgcagcagagtggaagatgattgagccagagtctgttggggatgatctgaggcagcaggcaaaacagatttgctatgggatcatttatggaatgggagctaaatctttgggagagcagatgggcattaaagaaaatgatgctgcatgctatattgactccttcaaatccagatacacagggattaatcaattcatgacagagacagtgaagaattgtaaaagagacggatttgttcagaccattttgggaaggcgtagatatttgccaggaatcaaagacaacaacccttatcgtaaagctcacgctgagcgtcaagctatcaacacaatagtccaaggatcagcagctgatattgtcaaaatagccacagttaacattcagaagcaattagagaccttccactcaaccttcaaatcccatggtcatcgagagggtatgctccaaagtgaccaaacaggattgtcacgaaagagaaaactgcaagggatgttctgcccaatcagaggaggcttcttcatccttcaactccatgatgaactcctatatgaagtggcagaagaagatgttgttcaggtagctcagattgtcaagaatgaaatggaaagtgctgtaaaactgtctgtgaaattgaaagtgaaagtgaaaataggcgccagctggggagagctaaaggactttgatgtgtaactgtgctgttgatgaagtcctcccagggaagcctgtgcagatgcagtcacctggaaagaacagagattaccctttcacctacctcagcaaaacaaactttcaagtcttgatagacttagcctagtaattttatagtgagagtttcaaactatatatcagtgtctatagcatcaaaaacttctgggggcgtgggggaagtagaataccaagtataatagttacattcactttcaaagagcatctatgaatttgccttttgtaacttactgtggctttaaacatattcagaacagatgcttgaaatatgcacttagcactttggttccacatctgtctgggtaaaccatgaagaaaatgaagctgctgcctcaatcgacccagacagcagccataggcagataaagatttggtttcaccctggtggtggtaggcatcgtgtgtgactttttttcctctaatatcaattttacagtacggaaatagtattttaaaatagtattggctaataaattatgaattctataaagtagtaagacttggtatggttggagtgtaggaatgaatattcatgaaatgtttcttattgcttttccttccctaattcatacaatgaatgtatttggaatacttacatattataaaataaactatacctcttcaagaggtatcctgttctgtaagatcagatgtttttattgcaggtcaatataatactgccagagacagaaaatacccccttatcagtcccttagtgcctctttctgtttgtggcatggtgagaaaacccatgctgaaaagattgtactttgtgatcccaatcagagggatggagctaatctttttgctgttgaaataaaatgaatttatgagaaa

SEQ ID NO: 167442 - DNA, 9055 bp, Homo sapiens
  Payload ID: 12940
  Gene Symbol: POLQ
  Gene Name: polymerase (DNA directed), theta
  ENST ID: ENST00000621776
  CDS Start-End: 1-8178
atgaatggtcaccgttttacgttcagaactcgttcgcttctacctttacaaaagggacaacacagatgcattactaagctcttggctcataacgatccctggggtatattcagagccccttcctcgcggcgttcatatagtgtctcaggggtctgtcagccagcaatccccaattcctcattacatattcctcacaatgcatgctggctaaaatggaaattgtgttcagaaatagccctgccctaccatcatatactaggagaaaggaggaaattatgctctattagaaactttgaagactggcgggaagatgtccgcagctgttgccaggccagggttctcccgagagggaggacgctgggactgtggcttgccctgatcggccgagaagagtttgccatgaatcttctgcgtcggagtgggaaacggcggcgttcagaatcaggctcagattcgttctcgggaagcggcggtgacagcagtgccagcccccagttcctctccgggtccgtgctgagcccgccgcccggccttggtcgctgcctgaaggccgcagctgcaggagaatgcaagcctacagttcctgactacgaaagagacaagctactattggcaaactggggacttcctaaagcagttctggaaaaataccacagttttggtgtaaaaaagatgtttgaatggcaggcagagtgccttttgcttggacaagtcctggaaggaaagaatttagtttattcagctcctacaagtgctgggaagactcttgtggcagaattacttattttgaagcgggttttggaaatgcggaagaaagctttgtttattcttccctttgtttctgtggctaaagagaagaaatactacctccagagtctgtttcaggaagtaggaataaaagtagacggttatatgggcagcacctctccatcaaggcatttctcttcattggatattgcagtctgcacaattgagagagccaatggtctgatcaatcgcctcatagaggaaaataagatggatctgttaggaatggtggttgtggatgaattacatatgctgggagactctcaccgagggtatctgctggaacttttgctgaccaagatttgctatattactcggaaatcagcatcttgtcaggcagatctagccagttctctgtctaatgctgtgcaaatcgttggcatgagtgctacccttcctaatttggagcttgtggcttcctggttgaatgctgaactctaccataccgactttcgccctgtaccgcttttggagtcagtaaaagttggaaattccatatatgactcttcaatgaaacttgtgagggaatttgagcccatgctacaagtgaagggagatgaggaccatgttgttagtttatgttatgagacgatttgtgataaccattcagtattacttttttgtccatcaaagaaatggtgtgagaagctggcagatatcattgctcgagagttttataatctacatcatcaagctgagggtgaaggattggtgaaaccctctgaatgcccaccagtaattctggaacaaaaagaactcctggaagtgatggatcagttaagacgtttgccttcaggactggactctgtattacagaaaactgtaccatggggagtagcatttcatcatgcaggtcttacttttgaggagagggatatcattgaaggagcctttcgtcaaggtctcattcgggtcttggcggcaacttctactctttcttctggggtgaatttacctgcacgtcgtgtgattattcgaacccctatttttggtggtcgacctctagatattcttacttataagcagatggttggccgtgctggcaggaaaggagtggacacagtaggcgagagtatcttaatttgtaagaactctgagaaatcaaaaggcatagctctccttcagggttctctaaagcctgttcgcagctgtctgcaaagacgagaaggagaagaagtaactggcagcatgatacgagctattctggagataatagttggtggagtggcaagtacatcacaagatatgcatacttatgctgcctgcacatttttggctgcaagtatgaaagaagggaagcaaggaattcagagaaatcaagagtctgttcagcttggagcgattgaggcctgtgtgatgtggctactagaaaatgaattcatccagagtacagaagccagtgatggaacagaaggaaaggtgtatcatccaacacatcttggttcggccactctttcttcttcactttctccagctgatactttagatatttttgctgacctgcaaagagcaatgaagggctttgttttagagaatgatcttcatattctctatctggttacacctatgtttgaggattggactactattgattggtatcgatttttctgtttatgggagaagttgccaacttcaatgaaaagggtggcagagctagtgggagttgaagaggggttcttggcccgttgtgtgaaaggaaaagtagtagccagaactgagagacagcatcgacaaatggccatccataaaaggtttttcaccagtcttgtgctattagatttaatcagtgaagttcccttaagggaaataaatcagaaatatggatgcaatcgtgggcagattcaatctttgcaacagtcagctgctgtttatgcagggatgattacagtattttccaaccgtctgggctggcacaacatggaactactactttcccaatttcagaagcgtcttacgtttggcatccagagggagctgtgtgacctggttcgggtatccttactaaatgctcagagagccagggttctctatgcttctggctttcatactgtggcagaccttgctagagcaaatattgtggaggtggaggtgattctgaaaaatgctgtgcctttcaaaagtgcccggaaggcagtggatgaggaagaggaagcagttgaagaacgtcgcaatatgcgaactatctgggtgactggcagaaaaggtttaactgaaagggaagcagcagcccttatagtggaagaagccagaatgattctgcagcaggacttagttgaaatgggagtgcaatggaatccatgtgccctgttacattctagtacatgctcattgactcatagtgagtccgaagtaaaggaacacacatttatatcccaaactaagagttcttataaaaaattaacatcaaagaacaaaagtaacacaatatttagtgattcttatattaagcattcaccaaatatagtgcaagacttaaataaaagtagagagcatacaagttcctttaattgtaatttccagaatgggaatcaagaacatcagacatgttccattttcagagcaagaaaacgggcctctttagatataaataaagagaagccaggagcctctcagaatgaggggaaaacaagtgataagaaagttgttcagactttttcacagaaaacaaaaaaggcacctttgaatttcaattcagaaaagatgagcagaagttttcgatcttggaaacgtagaaagcatctaaagcgatctagggacagcagccccctgaaagactctggagcgtgtagaatccatttacaaggacagactctgtctaatcctagtctttgtgaagacccgtttaccttagatgagaagaaaacggaatttagaaattcagggccatttgctaaaaatgtatctttgagtggtaaggaaaaagataataaaacatcattcccattacaaataaagcaaaattgttcatggaacataacactaactaatgataattttgtggagcatattgtcacaggatctcagagtaaaaatgtgacttgtcaggccactagtgtggttagtgaaaagggcagaggagtagctgttgaggcagaaaaaataaatgaagtgctgatacaaaatggttcaaaaaaccagaatgtttatatgaaacaccatgacatccatccaattaaccagtacctgcgaaagcaatctcatgaacagacaagcactattaccaaacagaaaaatataatagagagacaaatgccctgtgaagcagtcagtagttacataaatagagactcaaatgttactatcaattgtgaaaggataaagcttaatacagaggaaaataaaccaagtcattttcaggcattaggagatgatataagcagaactgtgatacccagtgaagtacttccatcagctggagcatttagcaaatcagaaggccagcatgagaattttctaaatatttctagactacaagaaaaaacaggtacttatacaacaaacaaaactaaaaataatcatgtttctgacttaggtttagtcctctgtgattttgaagatagtttctatctggatactcagtcagagaaaataatacaacagatggcaactgaaaatgccaaactaggagcaaaggacaccaacctggcagcagggataatgcagaagagcttagtccaacagaactcaatgaactcttttcagaaggagtgtcacattccttttcctgctgaacagcaccctctaggagcgactaagatagatcatttggaccttaagactgtaggtactatgaaacaaagcagtgattcacatggggttgatatcctgactccagaaagcccgattttccattctccaatactattggaggaaaatggtctttttttaaaaaagaatgaagtttctgttactgattcacaattaaatagttttcttcaaggttatcaaacacaagaaactgtgaaaccagttatacttctgattcctcaaaagagaactcccactggtgtagaaggagaatgtcttccagttcctgaaacaagtttgaatatgagtgatagtttactatttgatagcttcagtgatgactatctagtaaaagaacaattacctgatatgcaaatgaaagaaccccttccttcagaagtaacatcaaaccattttagtgattctctgtgtctacaagaagacctaattaaaaaatcaaatgtaaatgagaatcaagatacccaccagcagttgacttgttccaatgatgaatctattatattttcagaaatggattctgttcagatggttgaagctttggacaatgtggatatatttcctgtccaagagaagaatcatactgtagtatctcctagagcattagaactaagtgatccagtacttgatgagcaccaccaaggtgatcaagatggaggagatcaagatgaaagggctgaaaaatcaaaattaactgggaccaggcaaaatcattcattcatatggtcaggggcatcatttgatctaagtccaggactgcaaaggattttagataaagtatccagtcctctagaaaatgaaaagctaaaatcaatgactataaacttttccagtttgaatagaaaaaatacagagttaaatgaagaacaagaagttatttcaaacttggagacaaaacaagtgcagggaatttcattttcttctaataatgaagtaaaaagcaagattgagatgctagaaaacaatgccaatcatgatgaaacctcatccctcttacctcgtaaagaaagtaatatagttgatgataatggtctcattcctcctacacccattccaacatctgcttctaagctgacatttccagggattcttgaaacacctgtaaacccttggaaaactaataatgttttacaacctggtgaaagttatttatttggctcaccttcagatattaaaaaccacgatttaagtccagggagtagaaatgggttcaaagacaacagccctattagtgacacaagcttttcacttcagttatcacaggatggattacagttaactccagcctcaagcagttcagaaagtttgtccataattgatgtagcaagtgaccaaaatcttttccaaacattcattaaggagtggcggtgcaaaaagcgattttccatctcactggcttgtgaaaagattagaagtttgacatcttctaaaactgctactattggcagtaggtttaagcaagctagctcacctcaggaaattcctattagagatgatggatttcccattaaaggttgtgatgacaccttggtggttggactggcagtatgctggggtggaagggatgcctattatttttcactgcagaaggaacaaaagcattctgaaattagtgccagtttggttccaccttctttagatccaagcctgactttgaaagacaggatgtggtaccttcaatcttgcttgcgaaaggaatctgataaagaatgttctgttgtcatctatgacttcatccagagctataaaattcttcttctttcttgtggcatctccttggagcaaagttatgaagatcctaaggtggcatgctggttactagatccagattctcaggagccgactcttcatagcatagttaccagttttcttcctcatgagcttccactcctagaagggatggagaccagccaagggattcaaagcctggggctaaatgctggcagtgagcattctgggcgatacagagcatctgtggagtccattctcatcttcaactctatgaatcagctcaactctttgttgcagaaggaaaaccttcaagatgttttccgtaaggtggaaatgccctctcagtactgcttggccttgctagaactaaatggaattggctttagtactgcagaatgtgaaagtcagaaacatataatgcaagccaagctggatgcaattgagacccaggcctatcaactagctggccacagtttttctttcaccagttcagatgacatcgctgaggttttatttttggaattgaagttgcccccaaatagagagatgaaaaaccaaggcagcaagaaaactctgggttctaccagaagagggattgacaatggacgcaagctaaggctgggaagacagttcagcactagtaaggacgttttaaataaattaaaggcattacatcctttaccaggcttgatattagaatggagaagaatcactaatgctattaccaaagtggtctttccccttcagcgggaaaagtgtcttaatccttttcttggaatggaaagaatctatcctgtatcacagtcgcacactgctacaggacgaataacctttacagaaccaaatattcagaatgtgccaagagattttgaaatcaaaatgccaacactagtaggagaaagcccaccttctcaagctgtaggcaaaggcctacttcccatgggcagaggaaaatataagaagggtttcagcgtgaatcctagatgccaggcacagatggaggagagagctgcagacagaggaatgccattttcaattagcatgcgacatgcctttgtgcctttcccaggtggttcaatactggctgctgactactctcagcttgaactgaggatcttggctcatttatcccatgatcgtcgtctcattcaagtgttaaacactggagctgatgttttcaggagcattgcagcagagtggaagatgattgagccagagtctgttggggatgatctgaggcagcaggcaaaacagatttgctatgggatcatttatggaatgggagctaaatctttgggagagcagatgggcattaaagaaaatgatgctgcatgctatattgactccttcaaatccagatacacagggattaatcaattcatgacagagacagtgaagaattgtaaaagagacggatttgttcagaccattttgggaaggcgtagatatttgccaggaatcaaagacaacaacccttatcgtaaagctcacgctgagcgtcaagctatcaacacaatagtccaaggatcagcagctgatattgtcaaaatagccacagttaacattcagaagcaattagagaccttccactcaaccttcaaatcccatggtcatcgagagggtatgctccaaagtgaccaaacaggattgtcacgaaagagaaaactgcaagggatgttctgcccaatcagaggaggcttcttcatccttcaactccatgatgaactcctatatgaagtggcagaagaagatgttgttcaggtagctcagattgtcaagaatgaaatggaaagtgctgtaaaactgtctgtgaaattgaaagtgaaagtgaaaataggcgccagctggggagagctaaaggactttgatgtgtaactgtgctgttgatgaagtcctcccagggaagcctgtgcagatgcagtcacctggaaagaacagagattaccctttcacctacctcagcaaaacaaactttcaagtcttgatagacttagcctagtaattttatagtgagagtttcaaactatatatcagtgtctatagcatcaaaaacttctgggggcgtgggggaagtagaataccaagtataatagttacattcactttcaaagagcatctatgaatttgccttttgtaacttactgtggctttaaacatattcagaacagatgcttgaaatatgcacttagcactttggttccacatctgtctgggtaaaccatgaagaaaatgaagctgctgcctcaatcgacccagacagcagccataggcagataaagatttggtttcaccctggtggtggtaggcatcgtgtgtgactttttttcctctaatatcaattttacagtacggaaatagtattttaaaatagtattggctaataaattatgaattctataaagtagtaagacttggtatggttggagtgtaggaatgaatattcatgaaatgtttcttattgcttttccttccctaattcatacaatgaatgtatttggaatacttacatattataaaataaactatacctcttcaagaggtatcctgttctgtaagatcagatgtttttattgcaggtcaatataatactgccagagacagaaaatacccccttatcagtcccttagtgcctctttctgtttgtggcatggtgagaaaacccatgctgaaaagattgtactttgtgatcccaatcagagggatggagctaatctttttgctgttgaaataaaatgaatttatgagaaacttt

SEQ ID NO: 167443 - DNA, 3821 bp, Homo sapiens
  Payload ID: 12941
  Gene Symbol: POLD3
  Gene Name: polymerase (DNA-directed), delta 3, accessory subunit
  Uniprot ID: Q15054
  ENST ID: ENST00000263681
  CDS Start-End: 130-1530
gtagtgcgtcgcctccgttgccggggaaacgacccgggacctgggagggagcaaagacgtttcccgccggcgggagctgtggctgtgattgagagaggggttagaggcgggtcccagcgctgccgcaccatggcggaccagctttatctggaaaatatagacgagttcgtcacggaccaaaacaagatcgtgacatacaaatggctgagctatacactaggggttcatgttaaccaggccaaacagatgctgtatgattatgttgaaaggaaacgaaaagaaaattcaggagcccaactgcatgttacctacttggtgtctggcagtctcattcagaatggacattcctgccacaaggttgcagtagtgagagaagataaattggaagcagtgaagtccaagctagctgtgactgccagcatccatgtgtacagcatccagaaagccatgctaaaggacagtgggcctctgttcaatactgactatgacatccttaaaagcaacttgcagaactgcagcaaatttagtgctatacaatgtgcagctgccgtccctagagctcctgctgaatcctcttcgtcttccaaaaagtttgagcagtcacatcttcacatgtcaagtgagacacaagccaacaatgagctgaccaccaatggtcatggcccacctgcatccaagcaggtttcccagcagcccaaaggaattatgggaatgtttgcctccaaagctgctgctaaaacccaagaaaccaacaaggaaacgaaaacagaggctaaagaagtaacaaatgcatctgcagcaggcaacaaggcaccagggaaagggaatatgatgagcaacttttttggaaaagctgctatgaataaatttaaagtcaatttggactcagaacaagcagtgaaagaagaaaaaatagtggagcagcctacagtgtctgtcacggaaccaaagctggcaactcctgcaggcctgaaaaaatccagcaaaaaagcagagcctgttaaggtgctgcagaaggaaaaaaaaagggggaagcgagtagcattatctgatgatgagacaaaggaaactgaaaacatgaggaaaaagaggagaagaatcaaacttcctgaatctgatagcagtgaagatgaagtctttccagactctcctggggcttatgaagctgagtcaccatccccacctcctcctccgtctccacctcttgaaccagtgccaaagactgagcctgaacctccttctgtcaagagctcaagtggagaaaacaaaagaaaacgaaaacgcgtactaaaatctaaaacttacctggatggggaaggctgcatagtgactgaaaaagtctacgagagtgaatcctgcacagatagtgaagaggagcttaacatgaagacatcctcagtacacagaccccctgccatgactgtgaaaaaagaacccagagaggaacgaaagggccccaagaaagggactgctgctctgggcaaagccaacagacaggtgtccattactggcttcttccagaggaaataaactgccatctctggtagatcagagacttggagtggtcaagggagaagaccaagaaatgtactcctcacttactatgtaagttcatctagatctccacctcacctgtatcaaaagactgttctttcatcctgtgaggtttatactatttctggtttttaaccaaaaggaaatcatctggaagcaggaggcaaaaagctgttaccttctaatgacatttaaaaagcacagtctttgacctgtccaggagaaggatttactccaaaattatactggaacagttttcagaattctcactgaagccatttagtggctaacccactgtgctccactcaccctatgccctggtccgcatatggcacaggaattattccttcttgttcctctgtattctaagaattcatgtgggtgtttcttatccttacattctgctggatacgtttacccctcttgtcttcctgcagtaccacacttctgtcccctaacctcctgaggctgttctctgtaagtcttttaagttttggttggactaaaggctgaagtgaaaatctccctgtaatcctcttcctccattatgcagtacacggacacctggctacagaccaggacgtggcttgtgttctgttcctttcacaaaagctctctgggaccttcacttgcaattagtggttagggaaaagcctcaggcagaacacaaatagaaatttaatgatgtgttcaactccaccagaaattacctcgagtcagcattgacgatattggaggagctgccgtgctgctgatacggggtgtgctttatgctgctctttgcggtttgttgatcccctcctcccccactctcaatacctagagagtgaaacccgtacaatgagataaagactaaaaagagaaatcccttcctatatacagtgtgctacatttacaaaaaatttctccttaagaaaacagaatattcaaaaacagcacttttccaggaagttagtgaggaagataaggcacacatttatttataaatggatgttgctcctttgtatttttagcttccctatttgcttaaaagtacaggctccctaagagaggatggagagggagagactgaattgttagtaggtctaaacatcaaagaaaacatttttattagttacttatggaaaatcatctattacaatgataaccttcaagtgacttccattatggctggacaggcggtgagctcagtggattgcagtggtgtgctggtgattttgcacagtgagctctgcggaaggggtcaggctcaactgctgatgtgtctcacacgtagcagacaaggggtgtctgactggcttcttttgcctcaagatggtgtatgtcgtaagtgatgcaatcagctgtctgctttttaaggttgggattgtgctgactttgggattaacatgagcttctttagcaaccaagcatgaacttgattaagaccagaagtttgggagatgagtcctggcattatgtctaggactaaagcagtggctttgtatagcaagctgagtaaaggttgacatattccaaaacccttctttttaaaaggaaaaaggatggagagaaggatggaaagcctggacttaaacctttagaaaaaacttctggagagaaatcccttttaaacagttacttttgtcattgcctctggtcatttgtctaaataggaatggaaaattaaaagaaaagcaacaatccaatcttttttctaaaaattatgctggggtctcgactaaaactgaatttgaattggaaaattctggtgttggttggagttccatcttgcaagggataatacaaatcctatgatctctatgcccaatatgctgcctcaactctgagctgtctgcaaggcttagtaagtattgagtggtgttttttttttctttttatacaataccatgttaaccacatgagttaaataaatttgagaagttgttttaaaacagtgcttcaaactgagtatctgatgagtctcttatttgatggatggtaacagtgttgcaattatttaagctctgaatgggaagaaggctggttttcagttgatattgttaaaactgcatacccacagtctgagatgaacaagttatttgctgccttcatcgtttttttcagcactggggaaatgttagtttcagccaacctcattttttagttcatctagaagaaaatctagcacattgtattagtttggcttcatcacttgctagctgtatgactgtgggcaagtttcacagcctcaagttctttatcaaaataaaactaaaatgagttac

SEQ ID NO: 167444 - DNA, 513 bp, Homo sapiens
  Payload ID: 12941
  Gene Symbol: POLD3
  Gene Name: polymerase (DNA-directed), delta 3, accessory subunit
  ENST ID: ENST00000528481
  CDS Start-End: 181-513
aaagcgcggggccagactcatcggttcattcaacaaccagtatttagtgcctgctgtgttctgcaggccctgccataggcgcttgatacagcggtgcatagcgtatgagaaagatctgtcctggtgacatacaaatggctgagctatacactaggggttcatgttaaccaggccaaacagatgctgtatgattatgttgaaaggaaacgaaaagaaaattcaggagcccaactgcatgttacctacttggtgtctggcagtctcattcagaatggacattcctgccacaaggttgcagtagtgagagaagataaattggaagcagtgaagtccaagctagctgtgactgccagcatccatgtgtacagcatccagaaagccatgctaaaggacagtgggcctctgttcaatactgactatgacatccttaaaagcaacttgcagaactgcagcaaatttagtgctatacaatgtgcagctgccgtccctagagctcctgctgaatcctcttcg

SEQ ID NO: 167445 - DNA, 854 bp, Homo sapiens
  Payload ID: 12941
  Gene Symbol: POLD3
  Gene Name: polymerase (DNA-directed), delta 3, accessory subunit
  ENST ID: ENST00000530511
  CDS Start-End: 346-854
cagcgctgccgcaccatggcggaccagctttatctggaaaatatagacgagttcgtcacggaccaaaacaagatcgtgagcagctactactggggaacgcgggcgtgcgaccggggtcctgggcccggctagggcggcgggagccttgaccctctgtctgcttgtggcttcgtggggaccaggggagacaggtccccacgaggggacctgggcgagctctgtgccccagagcgagcgaggactcgtcgggaaggtcctccagcacacacggaagtccgcgtcccttgggtgacatacaaatggctgagctatacactaggggttcatgttaaccaggccaaacagatgctgtatgattatgttgaaaggaaacgaaaagaaaattcaggagcccaactgcatgttacctacttggtgtctggcagtctcattcagaatggacattcctgccacaaggttgcagtagtgagagaagataaattggaagcagtgaagtccaagctagctgtgactgccagcatccatgtgtacagcatccagaaagccatgctaaaggacagtgggcctctgttcaatactgactatgacatccttaaaagcaacttgcagaactgcagcaaatttagtgctatacaatgtgcagctgccgtccctagagctcctgctgaatcctcttcgtcttccaaaaagtttgagcagtcacatcttcacatgtcaagtgagacacaagccaacaatgagctgaccaccaatggtcatggcccacctgcatccaagcaggtttcccagcagcccaaaggaattatgggaatgtttgcctccaaagctgctgctaaaacccaagaaaccaacaa

SEQ ID NO: 167446 - DNA, 2122 bp, Homo sapiens
  Payload ID: 12941
  Gene Symbol: POLD3
  Gene Name: polymerase (DNA-directed), delta 3, accessory subunit
  Uniprot ID: Q15054
  ENST ID: ENST00000527458
  CDS Start-End: 491-1774
gctgtggctgtgattgagagaggggttagaggcgggtcccagcgctgccgcaccatggcggaccagctttatctggaaaatatagacgagttcgtcacggaccaaaacaagatcgtgagcagctactactggggaacgcgggcgtgcgaccggggtcctgggcccggctagggcggcgggagccttgaccctctgtctgcttgtggcttcgtggggaccaggggagacaggtccccacgaggggacctgggcgagctctgtgccccagagcgagcgaggactcgtcgggaaggtcctccagcacacacggaagtccgcgtcccttgggtgggcgtgctgggaacagagcctggggctggagccgcggagaccgggcgcggagggagggccgttggctgagagttctaaggcgtccctacacctttcttttaaggtgacatacaaatggctgagctatacactaggggttcatgttaaccaggccaaacagatgctgtatgattatgttgaaaggaaacgaaaagaaaattcaggagcccaactgcatgttacctacttggtgtctggcagtctcattcagaatggacattcctgccacaaggttgcagtagtgagagaagataaattggaagcagtgaagtccaagctagctgtgactgccagcatccatgtgtacagcatccagaaagccatgctaaaggacagtgggcctctgttcaatactgactatgacatccttaaaagcaacttgcagaactgcagcaaatttagtgctatacaatgtgcagctgccgtccctagagctcctgctgaatcctcttcgtcttccaaaaagtttgagcagtcacatcttcacatgtcaagtgagacacaagccaacaatgagctgaccaccaatggtcatggcccacctgcatccaagcaggtttcccagcagcccaaaggaattatgggaatgtttgcctccaaagctgctgctaaaacccaagaaaccaacaaggaaacgaaaacagaggctaaagaagtaacaaatgcatctgcagcaggcaacaaggcaccagggaaagggaatatgatgagcaacttttttggaaaagctgctatgaataaatttaaagtcaatttggactcagaacaagcagtgaaagaagaaaaaatagtggagcagcctacagtgtctgtcacggaaccaaagctggcaactcctgcaggcctgaaaaaatccagcaaaaaagcagagcctgttaaggtgctgcagaaggaaaaaaaaagggggaagcgagtagcattatctgatgatgagacaaaggaaactgaaaacatgaggaaaaagaggagaagaatcaaacttcctgaatctgatagcagtgaagatgaagtctttccagactctcctggggcttatgaagctgagtcaccatccccacctcctcctccgtctccacctcttgaaccagtgccaaagactgagcctgaacctccttctgtcaagagctcaagtggagaaaacaaaagaaaacgaaaacgcgtactaaaatctaaaacttacctggatggggaaggctgcatagtgactgaaaaagtctacgagagtgaatcctgcacagatagtgaagaggagcttaacatgaagacatcctcagtacacagaccccctgccatgactgtgaaaaaagaacccagagaggaacgaaagggccccaagaaagggactgctgctctgggcaaagccaacagacaggtgtccattactggcttcttccagaggaaataaactgccatctctggtagatcagagacttggagtggtcaagggagaagaccaagaaatgtactcctcacttactatgtaagttcatctagatctccacctcacctgtatcaaaagactgttctttcatcctgtgaggtttatactatttctggtttttaaccaaaaggaaatcatctggaagcaggaggcaaaaagctgttaccttctaatgacatttaaaaagcacagtctttgacctgtccaggagaaggatttactccaaaattatactggaacagttttcagaattctcactgaagccatttagtggctaacccactgtgctccactcaccctatgccctggtcc

SEQ ID NO: 167447 - DNA, 710 bp, Homo sapiens
  Payload ID: 12941
  Gene Symbol: POLD3
  Gene Name: polymerase (DNA-directed), delta 3, accessory subunit
  ENST ID: ENST00000524752
  CDS Start-End: 1-449
ctcctgcaggcctgaaaaaatccagcaaaaaagcagagcctgttaaggtgctgcagaaggaaaaaaaaagggggaagcgagtagcattatctgatgatgagacaaaggaaactgaaaacatgaggaaaaagaggagaagaatcaaacttcctgaatctgatagcagtgaagatgaagtctttccagactctcctggggcttatgaagctgagtcaccatccccacctcctcctccgtctccacctcttgaaccagtgccaaagactgagcctgaacctccttctgtcaagagctcaagtggagaaaacaaaagaaaacgaaaacgcgtactaaaatctaaaacttacctggatggggaaggctgcatagtggtgctggacatgcagtcccactcactagacattttggagcattacgtggaaatgcccatccagcggttggagaggtagggtaggatctgaagatctcaagcctcggaagcacagatttaggagtcactgacttagaggtggtagtttcaagtgacgtgatggttaagttcaccaagagaaaaagtttagaaagaaaaagagctgagccttctgccctattttttagaagagggtttctgagagcctgggtattcaaatgataagatgggtgtgtggtgcagggacaagacttcagtcagaggacccagggtctctgctttagcaccatcttgctgtgtg

SEQ ID NO: 167448 - DNA, 1700 bp, Homo sapiens
  Payload ID: 12941
  Gene Symbol: POLD3
  Gene Name: polymerase (DNA-directed), delta 3, accessory subunit
  Uniprot ID: Q15054
  ENST ID: ENST00000532497
  CDS Start-End: 270-1352
gctgtggctgtgattgagagaggggttagaggcgggtcccagcgctgccgcaccatggcggaccagctttatctggaaaatatagacgagttcgtcacggaccaaaacaagatcgtgacatacaaatggctgagctatacactaggggttcatgttaaccaggccaaacatgccacaaggttgcagtagtgagagaagataaattggaagcagtgaagtccaagctagctgtgactgccagcatccatgtgtacagcatccagaaagccatgctaaaggacagtgggcctctgttcaatactgactatgacatccttaaaagcaacttgcagaactgcagcaaatttagtgctatacaatgtgcagctgccgtccctagagctcctgctgaatcctcttcgtcttccaaaaagtttgagcagtcacatcttcacatgtcaagtgagacacaagccaacaatgagctgaccaccaatggtcatggcccacctgcatccaagcaggtttcccagcagcccaaaggaattatgggaatgtttgcctccaaagctgctgctaaaacccaagaaaccaacaaggaaacgaaaacagaggctaaagaagtaacaaatgcatctgcagcaggcaacaaggcaccagggaaagggaatatgatgagcaacttttttggaaaagctgctatgaataaatttaaagtcaatttggactcagaacaagcagtgaaagaagaaaaaatagtggagcagcctacagtgtctgtcacggaaccaaagctggcaactcctgcaggcctgaaaaaatccagcaaaaaagcagagcctgttaaggtgctgcagaaggaaaaaaaaagggggaagcgagtagcattatctgatgatgagacaaaggaaactgaaaacatgaggaaaaagaggagaagaatcaaacttcctgaatctgatagcagtgaagatgaagtctttccagactctcctggggcttatgaagctgagtcaccatccccacctcctcctccgtctccacctcttgaaccagtgccaaagactgagcctgaacctccttctgtcaagagctcaagtggagaaaacaaaagaaaacgaaaacgcgtactaaaatctaaaacttacctggatggggaaggctgcatagtgactgaaaaagtctacgagagtgaatcctgcacagatagtgaagaggagcttaacatgaagacatcctcagtacacagaccccctgccatgactgtgaaaaaagaacccagagaggaacgaaagggccccaagaaagggactgctgctctgggcaaagccaacagacaggtgtccattactggcttcttccagaggaaataaactgccatctctggtagatcagagacttggagtggtcaagggagaagaccaagaaatgtactcctcacttactatgtaagttcatctagatctccacctcacctgtatcaaaagactgttctttcatcctgtgaggtttatactatttctggtttttaaccaaaaggaaatcatctggaagcaggaggcaaaaagctgttaccttctaatgacatttaaaaagcacagtctttgacctgtccaggagaaggatttactccaaaattatactggaacagttttcagaattctcactgaagccatttagtggctaacccactgtgctccactcaccctatgccctggtcc

SEQ ID NO: 167449 - DNA, 564 bp, Homo sapiens
  Payload ID: 12941
  Gene Symbol: POLD3
  Gene Name: polymerase (DNA-directed), delta 3, accessory subunit
  ENST ID: ENST00000532954
  CDS Start-End: 1-268
taatgcttttgaagatgcatgtgagatggaggtggtgttctggggtctaattgctgaacgaatagtgactgaaaaagtctacgagagtgaatcctgcacagatagtgaagaggagcttaacatgaagacatcctcagtacacagaccccctgccatgactgtgaaaaaagaacccagagaggaacgaaagggccccaagaaagggactgctgctctgggcaaagccaacagacaggtgtccattactggcttcttccagaggaaataaactgccatctctggtagatcagagacttggagtggtcaagggagaagaccaagaaatgtactcctcacttactatgtaagttcatctagatctccacctcacctgtatcaaaagactgttctttcatcctgtgaggtttatactatttctggtttttaaccaaaaggaaatcatctggaagcaggaggcaaaaagctgttaccttctaatgacatttaaaaagcacagtctttgacctgtccaggagaaggatttactccaaaattatactggaacagttttcagaattctcactg

SEQ ID NO: 167450 - DNA, 544 bp, Homo sapiens
  Payload ID: 12941
  Gene Symbol: POLD3
  Gene Name: polymerase (DNA-directed), delta 3, accessory subunit
  ENST ID: ENST00000531615
  CDS Start-End: 131-544
aaaaatgctactgttcagaaaatttgatggactaccagatttcatttatcttttaagtcattaattaagagttgatcatgtaaaaactcttactgatgtcttacttgtgccttcttttctttggaataggatgctgtatgattatgttgaaaggaaacgaaaagaaaattcaggagcccaactgcatgttacctacttggtgtctggcagtctcattcagaatggacattcctgccacaaggttgcagtagtgagagaagataaattggaagcagtgaagtccaagctagctgtgactgccagcatccatgtgtacagcatccagaaagccatgctaaaggacagtgggcctctgttcaatactgactatgacatccttaaaagcaacttgcagaactgcagcaaatttagtgctatacaatgtgcagctgccgtccctagagctcctgctgaatcctcttcgtcttccaaaaagtttgagcagtcacatcttcacatgtcaagtgagacacaagccaacaatgagctgaccaccaatggtcat

SEQ ID NO: 167451 - DNA, 918 bp, Homo sapiens
  Payload ID: 12942
  Gene Symbol: POLD4
  Gene Name: polymerase (DNA-directed), delta 4, accessory subunit
  Uniprot ID: Q9HCU8
  ENST ID: ENST00000312419
  CDS Start-End: 148-471
ctctctcggtttgtctgggtcatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 167452 - DNA, 584 bp, Homo sapiens
  Payload ID: 12942
  Gene Symbol: POLD4
  Gene Name: polymerase (DNA-directed), delta 4, accessory subunit
  ENST ID: ENST00000531239
  CDS Start-End: 300-398
gtctgggtcatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccgga

SEQ ID NO: 167453 - DNA, 899 bp, Homo sapiens
  Payload ID: 12942
  Gene Symbol: POLD4
  Gene Name: polymerase (DNA-directed), delta 4, accessory subunit
  ENST ID: ENST00000530584
  CDS Start-End: 354-452
ctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggtctctgaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 167454 - DNA, 714 bp, Homo sapiens
  Payload ID: 12942
  Gene Symbol: POLD4
  Gene Name: polymerase (DNA-directed), delta 4, accessory subunit
  Uniprot ID: Q9HCU8
  ENST ID: ENST00000539074
  CDS Start-End: 116-355
ccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccgtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactgg

SEQ ID NO: 167455 - DNA, 904 bp, Homo sapiens
  Payload ID: 12942
  Gene Symbol: POLD4
  Gene Name: polymerase (DNA-directed), delta 4, accessory subunit
  ENST ID: ENST00000532830
  CDS Start-End: 359-457
cctggatggccaaggtgaaagaggaggtgactagagaagaaggtgtggagggtggtaggagcaggacagaagatgcagtggtagaaaaacccagagaccccatcctttccactcaagctgctgcgatggaagcacattaggccagagaacctggaccaggggaagagggagtgtctgggaaggcagtgagggactaggaaggactgcctgaaagaattctggcccacagggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 167456 - DNA, 1486 bp, Homo sapiens
  Payload ID: 12942
  Gene Symbol: POLD4
  Gene Name: polymerase (DNA-directed), delta 4, accessory subunit
  ENST ID: ENST00000529704
  CDS Start-End: 170-268
gggaggcgtccctccctggaccccggcgacttcctctctcggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaatcctgaccttcagtcctttactgtggccctgctttgactggcagtccctagcaagttaggagatgagagaggcaccactacagctcttttccttcaagaaagtcctaggccgaagagggaggagacagtcatcttgagacggatcaagtcctcggaagagctgagcgacctctggtgccccctggtggcccacagggaaactactcatgactcaccttctggagcagccagggaaaacctacctgactagccagccacctgccttgctaagcggtgcccacctcacaaacatgggtgctttgccagagaaggacccctggggtccatagctcatgaagtccaaacatatctatacattcccagcaagcacctctggcttcccacatcgggggccaccttgatccaaagcagggctggcgagggtctcaacttgcaggacctgctcagacatgaccatcatctgaggggctttggtaagaaactgatggctgggcgcggtggctcacacctgtaatcccagcactttgggaggccaaggagggcggatcacgaggtcaagagatcgagaccatcctggctaacatggtgaaaccccatctctactaaaaatacaaaaaattagccaggtgtagtcccagctactcaggaggctgaggcaggagaatggcgtgaacccgggaggcagagctggcagtgagctgagaccgcatcactgcactccagcctgggtgacagagagagaccccgtctcaaaaaataaaaaaatacaaa

SEQ ID NO: 167457 - DNA, 2121 bp, Homo sapiens
  Payload ID: 12943
  Gene Symbol: POLDIP2
  Gene Name: polymerase (DNA-directed), delta interacting protein 2
  Uniprot ID: Q9Y2S7
  ENST ID: ENST00000540200
  CDS Start-End: 75-1181
gggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggccacccttgccatttctgctcccagagtctcaggctccccttctgacccagtgtgcgcccttgactgctttctttgctgcccttccagggagctgcccccctggtagggcatgtgcctgtttccctctcagcctggaggctggctggacatctcctagggtcactgtgcctctcagctagttggcgggggtgctggactggactcttgttcactttaccttctgccaaatgcagagagggaggccagtgtcagggtcggagtggcctggctcttagcactgaccgaccattgccatttctggcctcgctaggcccaggagaggagggaggcaagccagtcgggtttcctggagcaatgggtgtgccagccctcagcatgactctgccaagcatccagaccacaaatgcaggaatttggctgaggagcagctttaggtatggattgatgactaagtcaagctacttcctgagcttctctcagatttccaagagccagagatgaattgtgctgcatcttgccccaattcttaggatttcttttcctccgccactgcagtgattgttagaggtagttttcttgaattaatattaaatcacagttccagcccttgtta

SEQ ID NO: 167458 - DNA, 1524 bp, Homo sapiens
  Payload ID: 12943
  Gene Symbol: POLDIP2
  Gene Name: polymerase (DNA-directed), delta interacting protein 2
  ENST ID: ENST00000618887
  CDS Start-End: 16-1068
gcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggccacccttgccatttctgctcccagagtctcaggctccccttctgacccagtgtgcgcccttgactgctttctttgctgcccttccagggagctgcccccctggtagggcatgtgcctgtttccctctca

SEQ ID NO: 167459 - DNA, 3441 bp, Homo sapiens
  Payload ID: 12944
  Gene Symbol: POLDIP3
  Gene Name: polymerase (DNA-directed), delta interacting protein 3
  Uniprot ID: Q9BY77
  ENST ID: ENST00000252115
  CDS Start-End: 106-1371
gcgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 167460 - DNA, 3323 bp, Homo sapiens
  Payload ID: 12944
  Gene Symbol: POLDIP3
  Gene Name: polymerase (DNA-directed), delta interacting protein 3
  Uniprot ID: Q9BY77
  ENST ID: ENST00000348657
  CDS Start-End: 75-1253
ttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 167461 - DNA, 783 bp, Homo sapiens
  Payload ID: 12944
  Gene Symbol: POLDIP3
  Gene Name: polymerase (DNA-directed), delta interacting protein 3
  ENST ID: ENST00000339677
  CDS Start-End: 1-558
atggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaa

SEQ ID NO: 167462 - DNA, 3491 bp, Homo sapiens
  Payload ID: 12944
  Gene Symbol: POLDIP3
  Gene Name: polymerase (DNA-directed), delta interacting protein 3
  ENST ID: ENST00000451060
  CDS Start-End: 106-1422
gcgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccagagaatgcatgtggaccctgtggggtggattctgaccactgagtgtttccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattcct

SEQ ID NO: 167463 - DNA, 579 bp, Homo sapiens
  Payload ID: 12944
  Gene Symbol: POLDIP3
  Gene Name: polymerase (DNA-directed), delta interacting protein 3
  ENST ID: ENST00000454057
  CDS Start-End: 4-573
aagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccagaatttatatgacctggatgaagatgatgatggtatagcttccgttcctactaaacagatgaagtttgcagcctcaggcggctttctccaccacatgggaccaggcctttccagtaattagactgct

SEQ ID NO: 167464 - DNA, 3337 bp, Homo sapiens
  Payload ID: 12944
  Gene Symbol: POLDIP3
  Gene Name: polymerase (DNA-directed), delta interacting protein 3
  ENST ID: ENST00000445215
  CDS Start-End: 13-858
cggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 167465 - DNA, 2006 bp, Homo sapiens
  Payload ID: 12944
  Gene Symbol: POLDIP3
  Gene Name: polymerase (DNA-directed), delta interacting protein 3
  ENST ID: ENST00000617178
  CDS Start-End: 55-744
gaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattcct

SEQ ID NO: 167466 - DNA, 1248 bp, Homo sapiens
  Payload ID: 12945
  Gene Symbol: POLE4
  Gene Name: polymerase (DNA-directed), epsilon 4, accessory subunit
  Uniprot ID: Q9NR33
  ENST ID: ENST00000483063
  CDS Start-End: 189-542
cgggtggctaggcgcgtgggaagagccggagcccgacccccgcccacccggtttcctggcagcgcactgccgcgtaggggcggagccgcgcgcctacacagggtgtggcctccagcccgcgcgggaaagggcctgcgccgcatgcgcgcgcacagtcggcggccgcgcgcagcacgctcaaggccgggatggcggcggcggcggcggcaggaagcgggacgccccgagaggaggagggacctgctggggaggcagcggcctcgcagccccaggccccaacgagtgtgcctggggctcgtctctcgaggttgcctctggcgcgagtgaaggccttggtgaaggcagatcccgacgtgacgctagcgggacaggaagccatcttcattctggcacgagccgcggaactgtttgtggagaccattgcaaaagatgcctactgttgcgctcagcagggaaaaaggaaaacccttcagaggagagacttggataatgcaatagaagctgtggatgaatttgcttttctggaaggtactttagattgattgccgagcggggcagttttgtgagccttcatctgaagccttcagttcacccctctgcacaggcctcagctttgaagaacggagtctttgcacttacacacactcttcctgttctgccttcacctatgccgggataagcagagatctcatcaattagctcttctctgcaaggtcttccactatttctgtctgtcttccatatcaagcctggatgcagctgctgctgcttagagcagagatgaagaaagtgttctgcataagtggcttcctgaatgatgaggaccagaataaaggtttttgatcaacctcagtccagtgtgttttataatctcgcctttgttcctaccctgtgactggagagtcaccatacctggtcacagaccttcctgatcttccctgccagccattctaacatacagtcctttcattaattttgttcttttatttttccagcacatcaccagaaagtggttccagaatttatggaacaccacttgccctcaggagttcaaataaatatggtcctagattgaaagccagttaaattttttttaagttttatttattgacatatccacatactctatatttcaccaatttaaagtgtacaattcagtggtatttagtatattcacaaatatgtacaccagtcatcacagtcgattttagaacattttatttatttatttattattattatacttta

SEQ ID NO: 167467 - DNA, 12749 bp, Homo sapiens
  Payload ID: 12946
  Gene Symbol: POLR1A
  Gene Name: polymerase (RNA) I polypeptide A, 194kDa
  Uniprot ID: O95602
  ENST ID: ENST00000263857
  CDS Start-End: 380-5542
attggctgaagcggaagaagacgaaagcaatcataaaatgggaggttgcaagctcatggtttgaaagacttcgtcacggaagctaaaagctctatacacccgatttgcctcggaggaattttcctaaatgattattttgatgtcttatatatctttgattgttttcaaaacaaaagagcgagcagagagtcgtacaactatttgttccccccccatgtagaagtgatctcatccacgtaaatgtcgttcctgcgaccgcttccgcgcgcaagcgcacgttgaatcgcgtggtgactccgggcttgaggttgaattaagaatagtcaggtggtgagtggaacgtctcttggggtgtcggaattcaaaacggacctggaggatgttgatctccaagaacatgccctggcggcggctgcagggcatttccttcgggatgtattcggctgaagagctcaagaaattaagtgttaaatccattacgaaccctcgatacctggacagcctggggaacccatcggcaaacggcctgtacgatttagctttgggccctgcagattccaaagaggtgtgctccacctgcgtgcaggacttcagcaactgttctgggcacctgggccacattgagctcccactcacagtgtataaccctctcctcttcgataagctgtacctgctgcttcggggctcttgtttaaactgccacatgctgacttgtccccgggccgtgattcacctcttactctgccagctgagggttctggaagtcggggccctacaagcagtctacgagcttgagagaattctgaacaggtttctggaagaaaatcccgatccctctgcctctgaaattcgggaggaattagaacaatacacaactgaaattgtgcagaacaacctcctggggtcccagggcgcacatgtaaagaacgtgtgtgagagcaagagcaagctcattgctctcttctggaaggcacatatgaatgctaagcgctgtccccactgcaagaccgggcgatccgttgtccgaaaggaacacaacagcaagttgactatcacgtttccagccatggtgcacaggacagctggccagaaggactctgagcccctgggaattgaggaagctcagataggaaaacgaggatacttaacacccaccagtgcccgcgaacacctttctgccctgtggaagaatgaaggattctttctgaactaccttttttcgggaatggatgatgatggtatggaatccagattcaatcccagtgtgttctttctagatttcttggtggtgccgccctcaaggtatcgcccagtcagtcgcctaggagaccagatgtttactaatggccagacggtgaacttgcaggctgtcatgaaggatgtagttctgattcgaaaacttctggcattgatggcccaagaacagaagttgccagaggaagtggccacacccactacagatgaggaaaaagactctttgattgctattgaccgatcctttttgagtacacttccaggccagtccctcatagacaaactttacaacatttggattcgccttcagagccacgtcaatattgtgtttgatagcgagatggacaaactaatgatggacaagtacccaggcattaggcagatcctggagaagaaagaaggcctgttccgaaaacacatgatgggaaagcgagtggactacgctgcgcgctcagtcatctgcccagacatgtacatcaacaccaacgaaattggaattcccatggtgtttgccacaaaactgacctacccacagccagttaccccatggaatgttcaggaacttaggcaagcggtcatcaacggccctaatgtgcacccaggagcctccatggtcatcaatgaggacggcagccgcacagccctgagcgctgtggacatgacccagcgagaggccgtggccaagcagcttctgaccccagccacgggggcacctaagccccaggggacaaaaattgtgtgccggcatgtgaagaatggggacattctgctactgaaccgacagcccacactgcacagaccctccatccaggcccaccgtgcccgcatcctgcctgaagagaaagtgctgcggctccactatgccaactgcaaggcctataatgccgactttgatggagacgagatgaatgcccatttcccccagagtgagctgggccgggccgaggcctacgtcctggcctgcactgatcagcagtaccttgttcccaaggatggccaaccattggcgggactgatccaggatcacatggtttcaggggcaagcatgactactcggggttgctttttcacccgggagcactatatggagctggtgtaccgaggactcacggacaaagtggggcgcgtgaagctcctttctccttccatcctgaagccctttccgctgtggacaggaaaacaggttgtgtcaacgctgctcataaatataatcccagaggaccacatcccactgaacttatctggaaaggcgaaaatcactgggaaagcctgggtgaaggaaactcctcgatccgttcctggctttaaccctgactcgatgtgcgagtcccaggtgatcatcagggaaggggagctgctctgcggagtgctggacaaggcgcactatgggagctccgcctacggcctggtccactgctgctatgagatctatggaggcgagaccagcggcaaggttctaacctgcctggcccgcctcttcaccgcctacctgcagctctacagaggcttcaccttgggcgtggaagacattttggtgaagccaaaggcagatgtcaagaggcaacgtatcattgaagaatccacccactgcgggccccaggctgtcagggctgcattaaacctgccagaagccgcatcatatgatgaggtccgaggaaaatggcaggatgcccatctgggcaaggaccagagggattttaacatgattgatctgaagttcaaggaggaagtgaaccattacagcaatgagattaacaaggcatgcatgccttttggcctacacagacagttcccagagaacagcctgcagatgatggtgcagtcgggagccaaaggttcaactgtgaacacgatgcagatctcgtgcctgctgggccagattgaactggaaggtcggagacccccgctgatggcgtctggcaagtcactgccctgctttgagccttatgagttcacccccagggctggtggctttgtcactggcaggttcctcaccggcatcaaacctcctgagttcttcttccactgcatggcaggacgagagggcctggtggacactgctgtgaaaaccagccgctcaggctatctccaaaggtgcatcatcaagcacctagaggggctggtcgtgcagtatgatctcacggtccgtgacagtgacggcagtgtggtgcagttcctgtatggggaggatggcctggacatccccaagacacagttcctgcagcccaagcagttccccttcctggccagcaactacgaggtgataatgaaatcacagcatctccatgaagttttatccagagcagatcccaaaaaagctctccaccacttcagagctatcaaaaaatggcaaagcaagcaccccaacaccctgctgagaagaggcgccttcttgagttattcccagaaaattcaggaagctgtgaaagccctgaaacttgagagtgaaaaccgcaatggccgcagccctgggactcaggagatgctgaggatgtggtatgagttggatgaggaaagccgaaggaaataccagaagaaggcggccgcttgtcctgaccccagtctgtctgtctggcgtcctgacatctactttgcatcagtgtcagaaacatttgaaacaaaggttgatgactacagtcaagagtgggcagctcaaacagagaagagttatgagaaatcagagctttctctcgacaggttgaggaccttgctgcagctgaagtggcagcgctcactgtgtgagccgggcgaggctgtgggcctgctggctgcccagagcatcggagagccctccacccagatgaccctcaacaccttccactttgcaggcagaggcgagatgaacgtcaccctgggcattccaaggttgcgggagattctcatggtggccagcgccaacatcaagacacccatgatgagcgtgcccgtgctcaacaccaagaaagccctgaagagagtgaaaagcctgaagaagcaactcaccagggtgtgcttgggggaggtgttgcagaaaattgacgtccaggagtccttctgtatggaagaaaaacagaacaaattccaggtgtaccagctgcggtttcagttcctgccacatgcatattaccagcaggagaagtgcctgagacccgaggacatcctgcgcttcatggaaacaagattctttaaacttctgatggaatccatcaaaaagaagaataataaagcatcagctttcaggaacgtaaacactcgaagagctacacagcgggatctggacaacgctggggagttggggaggagtcggggagagcaggagggtgatgaggaagaggaggggcacattgtggatgctgaagctgaggagggggacgccgatgcctctgatgccaaacgcaaggagaagcaggaggaggaggttgattatgagagtgaggaagaggaggagagggagggcgaggagaacgacgatgaagacatgcaggaggaacgaaatccccacagggaaggtgctcgaaagacccaagagcaagatgaagaggtgggcttaggcactgaggaggacccgtcccttcccgccctcctgacgcagccccggaaacccacccacagccaggagccccaggggcccgaggccatggagcgccgggtccaggctgtgcgtgagatccacccgttcatagatgactaccagtacgacaccgaggagagcctgtggtgccaggtgacagtgaagctccctctgatgaagatcaactttgacatgagctccctggtagtatctttggcccatggtgccgtcatctatgcgaccaagggcatcactcggtgcctcctgaatgaaacaaccaacaataagaacgagaaggagcttgtgctaaacacagaaggaatcaacctcccagagctattcaagtatgcagaggtcctggatctgcgccgcctctactccaacgacatccacgccatagccaacacgtatggcattgaggccgcgctgcgggtgatcgagaaggagatcaaggatgtgtttgccgtgtatggcatcgcggtcgaccctcgccatctctccctggttgctgattatatgtgcttcgagggtgtttacaagccactgaatcgctttgggatccggtcaaactcttccccgctacagcagatgacatttgaaaccagcttccagtttctgaagcaagccaccatgctgggatcccacgatgagctgaggtctccttctgcctgccttgtggtcgggaaggtcgtcaggggcgggacaggcctgttcgagctcaagcagcctctgagatagcagctaccccggcaccatctgcccagctccaaggacccttggtgagggcgtggcccagcctgccttctgcatgagaggaccaggagactggaatccagggcagttccaagtgacagtacagagcacagcagcgaccttgggcctgaaagcagtgggcctctgagctgggccagcttcacctggaaagtgacagagttgctcatccttgcccctccctgtctctggatttttatcaaggtttaccaagtcttctgagtccccctgagatggctggggcctcacctgtgctgcaggaggcctctgtggcataacccctaaggagaagtcctgattcacgattcactgagaagaccaaggggaagccatgctttgctgctggggaccccaggcacctccagagtagggaagcggggttcttttgctgtgagtggccagggacaacagacaagattcctgggggctcccgatgagcaggaacgtggagcctgctgcccaaggcctgctccttccggctgctccagcccctgggggcagagtccacaaagagtccccatcaagacttcttccctgagtcaagtacagcgtagcatagtcctccacccacccaacctctctgcctggccagggtcctggccctgccactgtgtggcgaggtgtccttctagaccacatcagccccaaggctgggagcagtcgctccagggccgcagcagttcactcccacacatagaacccaggtcactgctggggcgattgaacaggttgcctggcttttctctgctgtcagtttggtgtggaggcctatgttctgccccatacaccccacaggccctgcttatgggaaggaacacaggcctccagcccagaggactgtgccgccctgttcttggccgtccacgtttcctctccctctagcaccagcaatacatttccctggcatggacagaaaagacagagaggacttatacaaaggctttgtaaaaccagaggctagcttctatctttgtctactgttatttcagctcagggcgggtaattaacatcattggaactagctattaggaaagaaaaaaaacttggttttttttacaacaattttttcccttggtttgcagtttctgcatttggatttgagaacccagggcggggattttcttggcacagtcaggtcttgggtccctcttcctgtgctttcttgtctgaggccttagggggaagagctcagcctctgcagcctcctccacctctgcccctggcctgcctctgctgtgacctccttccagagctagctgctggccctgtggccaggagaagcagaggggagaagcctttatgcagaagctgtgctagccttggtctggggtggggaggctgctgctgtgaccttaggggtagggttggggatcaagggaggctttgtcaagggagagtgaccatgttgctccctacatccatgcaataggacccagcctgcacctcctaggcctacactggggaaagcctgacagaaatcagtacctcctaacggggtctgccaggttcaccaaggcatgggcacagaggaatatgacagttttgaggcaggcaggaagggcccagcctgcagggtaagacattcattctttgagttaaaggccatattcacttgatgatttctacacacactagaattgtgagagtgtccttgaaggagatcacaaagtaacctggtgactgtggcacagggtccgtggattccatctctcccaggcactgagggcgcagaggcgaaggagcaagccctgcatattggcagggctgtgaccatcgcacttagatcagacccccgacctgtgttgggatgtgagggatgccctcctgccccacccatccacatggttcctgggcagctctgttttattcctgtgtctttcctgatggatgagtattaagacagcatgtctggtttttaaacagacatttgggagcttgcacatcctgatgagcagggactcactgtggtggccttagggaattacacgctcactttggtggttctctatgctcggaagcctctgagagtggccttggcagcttaagatggcagaggctttggagtcttcttaggactgtaagtgcccattgaggatgcatttgagttttggaaagtaggcccaagtcaaatctgatggatggattcaagaacatggactaatctgcgttgtcatttttaatcaaaatgtaatggagattgatcatctggtggggttcacaaacttttcatgagagctgtgagttctttttttgagatgcacttttgcacttgttacccaggctgagtgcaatggcgcaatctcggctccactgcaacctccatctcccgagttcaagcgattctcctgcctcagcctcccgagtagctgagattacaggcatgcgccaccacgcctggctaatttttgtatttttagtagagatggggtttcaccatgttggccaggctagtctcgaactcctaatctcaggtgatccgcctgcctcagcctcccaaagtgctgggtttacaggcgtgagctactgtgccggccagagctatgagttctttcagaatcctcagatgccattagctagccactgtttggacatccttctcaccttgccctttggggtgatatccatacctacttgcttgcttctaacagtttttttatttgttttgtagagacgggttttggtttattgctcaggctggtttcaaactcctaggctcaagcggtcctcccactgtggcctcccaaagtgctgggtggtgtgagccaccgtgcctggccagttaattttttttagtgtctcttttttgggttctcaccagaaacactatcagcattcccacagatattcctgtgagtctttgaaacattttctatcctgcattgagtaagaataaaaccgaggaaggggtgaagcaccttgtctcatccccagtctggaacttgaaccttcttttctcttcactttgccctacccccaaataatatgtacaaatgtctgtatccattgagcactaactccctattccttccacctccccagcccctggcaaccactgttctacgttctgtctctacgaatttgacttctctaggtccctcatacaagtggaaaagtacagcatgtctttttgtgaccggcttatttcacttagcataatgtcctcaaggttcatccatgctgtagcatgtgtcagaattgccttcttgcttgaggctgctgatacctcctcatgtgtatataccgtattttgtttaatcactcatctgttggtggacacttgggttgcctccacctcttggctgttgcaaataacgctgtgaacatggatatacagatatctgaggccaggccaggcgttcacacctgtaatcccaatacgttgggaggccgaggcgggcagatcatctgaggtcaggattcgagaccaccctggccaacatggcaaaaccccatctctactaaaaatacaaaaattagctgggtgtggtggtgcgcgcctataatcccagctactcgggaggctgaggcaggagaatcttgaactcaggaggtggaggttgcagtgagccgagattgcgccactgcactccagcctgggtgacagagtgagattccgtctcaaaaaaaaaaaaaaacaaaaactcagaccctgctttcctttgaatatatactagaagtggaattgctggatcatatggtaattctttaatttttctgggggaactgctgtcccattttccacagcagctacaccattttatgttcccaccaacggtgtacaacaatttcaatttctccacatccttgttcttgttaatagtagccaccctaatgtgtatgaggtgccatctcgtggtttggtgtgggctgtgtttcaatcagatgttgggacccttaagtgttctgcacctggggagagttaggaaccacttaaggagtgtctgttgcttgccaatcttaaaatttttagtttgcacctgaatcaggggctgtcagagtccagactgctcttgaaatagaaaagactggtcgttaaaggctggttcgttgagtctttcatcgttgagtgataccacctctgcagatggctcagtggggcagccccgtaccacagcctgcccttgaggttgtgtagtttagataggtcacagagttgctgggcctaccgcaggtctcctgaccctggtgcagttttacttcaattacaaccaccaaaatagctacagtcaaaaattccaaagttcctacaccatcaacctccaccccacttccgtccaaagtccacttagaggctctcagttttggaccttagaaacacttagggagctttttaaaaagatcgattctgtatttttagtagagatggggtttcacccagctactcaggaggctgaggcaggagaatcacttgaaccggggagttggaggttgcagtgagccgagattatgtcactccagcctgggcaacagagtgagactccgtcttaggaaaaaaaaaaagattgattctggccgggcacagtggctcacgcttacagtcccagcactttaagagactcaggcaggaggatcacttgagcttaggagtttgagactagcctgggcaacccagtgagaccccgtatctacaaaaattagccaggtgttgtgacatgtgcctgtggtcccagctactcaagaggctgaggtgagaggagcaagtgagcccaggagttcaaggctgcaatgagctgtgatcgcaccactgcactccagctcgggtgacaagagtgagaccccgtctgaaaaaaagattgatcccaaggccttgcccagattctgattttattggcctggagtgtggcctaggcattagaaaatcttcaagagagtctaaggtgcagcggaattgagagccacggacagaaaaagccctaaattgtggaaatgcacagccaccgtcaccacctatcggtacgatgacatctcaaggagtcactggccctaggtttctgcagtaggatcttaagatctgatctctgccctcaagtgagtgcacgtgcagtaaagctgtcatcgtgccatgacagatgtctgcaaggactttacagtggggtccaaaggatgccaccatcagctccacctggggctcaacaaagcctgaaagaagaaagggatgatgcttccagcagaaacctggaggcctgcagctctgccagcccagcacagcaagcgaggccatttgtccagcaggggcagaaggagggaactcagccagccagcgtttcctacaagcagctccatgagaggtttccacttaaaatgctaaatcataattatttaatcagattcgttccttaagttctttaagcagcatcgctgtcctaccacgagtggtcatcaaggagcagggtttaactcaactctgagttacccggcagggtacctgggtaactgcctgggttgaggtacccagcaggcttcatgtgcatgtgcacactgccccctgataggacctggtttattcacaggctcaggtgtcactgcagctccccagtgactatcttcgcgcaagttggactcaatggcctgggaggtttgtcccagccgacagatacctgaccatgcccatcctcaccattccctcccccatgctgcatccatccaaccttgatctccactgtgtcccaggcaccctaagatgcacaagctatgtgggccctgccctcacagaacttgtagtcttctgccccaaacaagccagttcaccgtcttcatgatcaggccaaaggttgaggtacccagcaggcttcatatgcacatgcacactgtcccctataggaccatgccttgcccagctggctgcactctagagggtgctttgtaggaaggacagagtggagaggacagtggggaggtacttgggtgttcaacagccagaagggagggaaactgaaaaagaatcaggagtccagccatcccctccccacctcctgcccccacttccaccctggctgctggccctttgcccttgaatatgggtgatataggtgtggctattcagttccagtcacagtgctgcctctatgtcttttgcaagctggggtcttccttactcagaaggcctggaggccctgccagatgctgccttccggactggctgcccgctgcagtgttttcacgggagccaagccagccccgggcctgtagcctcccatgtgacaaagtttcagacaccacagtcctcagctggaccacagtaaacacttgccttccccaacccatgattcttgcttggaaacatgaacctgatgttccacgtgcgttcagccaatcaaacctcaagaatgtgattgagcagtgaggctgcgttttgggcaagacactgagctctgaaataagacttttcttggaatctcaagccctcaacttacagtgggaccctaagaaatgcacttcagtttccttttatgtaaaatggtggtaaaattaattgtgttcattaaattgcacacaactatacatgtttacctatacactaagtggttctcaacttggggcaatttgccccccaggggacattcagcagtgtctgcggacattttttgttgctactggagggaggtgctactggcatctagggagtggaggctagagatgctgctaaactacagtccacaggacagtctccacagcaaagaattgtccagccccaaatatcaataatgccgaggttgaggaaaccctgccacatacacatagatgcgggttaacattgtttattttacaaagtggaatcatttacattttagccattctgatagatgaagcagtggcatctttttttttttttttttttttttgagacggggtctcactctgttgcccaggctggagtgcagggttgcaatcacggctcacagcagcctcgaagtcccaggaccaagcaaccctcccaccgcagccttccaagtaactgggactacaggcacacaacaccatgcccagctaattttttaatttttttgtagagacggggtttcaccatgttgcccaggctcaaactcctgagctcacacgatctgctgccttcaccttccaaagtgctgggattacaggtgtaagccactatgcccagcctcatttgtacttcagtttgcaattctctattaataaatctaagcatcttttcaca

SEQ ID NO: 167468 - DNA, 6454 bp, Homo sapiens
  Payload ID: 12946
  Gene Symbol: POLR1A
  Gene Name: polymerase (RNA) I polypeptide A, 194kDa
  ENST ID: ENST00000409681
  CDS Start-End: 380-5359
attggctgaagcggaagaagacgaaagcaatcataaaatgggaggttgcaagctcatggtttgaaagacttcgtcacggaagctaaaagctctatacacccgatttgcctcggaggaattttcctaaatgattattttgatgtcttatatatctttgattgttttcaaaacaaaagagcgagcagagagtcgtacaactatttgttccccccccatgtagaagtgatctcatccacgtaaatgtcgttcctgcgaccgcttccgcgcgcaagcgcacgttgaatcgcgtggtgactccgggcttgaggttgaattaagaatagtcaggtggtgagtggaacgtctcttggggtgtcggaattcaaaacggacctggaggatgttgatctccaagaacatgccctggcggcggctgcagggcatttccttcgggatgtattcggctgaagagctcaagaaattaagtgttaaatccattacgaaccctcgatacctggacagcctggggaacccatcggcaaacggcctgtacgatttagctttgggccctgcagattccaaagaggtgtgctccacctgcgtgcaggacttcagcaactgttctgggcacctgggccacattgagctcccactcacagtgtataaccctctcctcttcgataagctgtacctgctgcttcggggctcttgtttaaactgccacatgctgacttgtccccgggccgtgattcacctcttactctgccagctgagggttctggaagtcggggccctacaagcagtctacgagcttgagagaattctgaacaggtttctggaagaaaatcccgatccctctgcctctgaaattcgggaggaattagaacaatacacaactgaaattgtgcagaacaacctcctggggtcccagggcgcacatgtaaagaacgtgtgtgagagcaagagcaagctcattgctctcttctggaaggcacatatgaatgctaagcgctgtccccactgcaagaccgggcgatccgttgtccgaaaggaacacaacagcaagttgactatcacgtttccagccatggtgcacaggacagctggccagaaggactctgagcccctgggaattgaggaagctcagataggaaaacgaggatacttaacacccaccagtgcccgcgaacacctttctgccctgtggaagaatgaaggattctttctgaactaccttttttcgggaatggatgatgatggtatggaatccagattcaatcccagtgtgttctttctagatttcttggtggtgccgccctcaaggtatcgcccagtcagtcgcctaggagaccagatgtttactaatggccagacggtgaacttgcaggctgtcatgaaggatgtagttctgattcgaaaacttctggcattgatggcccaagaacagaagttgccagaggaagtggccacacccactacagatgaggaaaaagactctttgattgctattgaccgatcctttttgagtacacttccaggccagtccctcatagacaaactttacaacatttggattcgccttcagagccacgtcaatattgtgtttgatagcgagatggacaaactaatgatggacaagtacccaggcattaggcagatcctggagaagaaagaaggcctgttccgaaaacacatgatgggaaagcgagtggactacgctgcgcgctcagtcatctgcccagacatgtacatcaacaccaacgaaattggaattcccatggtgtttgccacaaaactgacctacccacagccagttaccccatggaatgttcaggaacttaggcaagcggtcatcaacggccctaatgtgcacccaggagcctccatggtcatcaatgaggacggcagccgcacagccctgagcgctgtggacatgacccagcgagaggccgtggccaagcagcttctgaccccagccacgggggcacctaagccccaggggacaaaaattgtgtgccggcatgtgaagaatggggacattctgctactgaaccgacagcccacactgcacagaccctccatccaggcccaccgtgcccgcatcctgcctgaagagaaagtgctgcggctccactatgccaactgcaaggcctataatgccgactttgatggagacgagatgaatgcccatttcccccagagtgagctgggccgggccgaggcctacgtcctggcctgcactgatcagcagtaccttgttcccaaggatggccaaccattggcgggactgatccaggatcacatggtttcaggggcaagcatgactactcggggttgctttttcacccgggagcactatatggagctggtgtaccgaggactcacggacaaagtggggcgcgtgaagctcctttctccttccatcctgaagccctttccgctgtggacaggaaaacaggttgtgtcaacgctgctcataaatataatcccagaggaccacatcccactgaacttatctggaaaggcgaaaatcactgggaaagcctgggtgaaggaaactcctcgatccgttcctggctttaaccctgactcgatgtgcgagtcccaggtgatcatcagggaaggggagctgctctgcggagtgctggacaaggcgcactatgggagctccgcctacggcctggtccactgctgctatgagatctatggaggcgagaccagcggcaaggttctaacctgcctggcccgcctcttcaccgcctacctgcagctctacagaggcttcaccttgggcgtggaagacattttggtgaagccaaaggcagatgtcaagaggcaacgtatcattgaagaatccacccactgcgggccccaggctgtcagggctgcattaaacctgccagaagccgcatcatatgatgaggtccgaggaaaatggcaggatgcccatctgggcaaggaccagagggattttaacatgattgatctgaagttcaaggaggaagtgaaccattacagcaatgagattaacaaggcatgcatgccttttggcctacacagacagttcccagagaacagcctgcagatgatggtgcagtcgggagccaaaggttcaactgtgaacacgatgcagatctcgtgcctgctgggccagattgaactggaaggtcggagacccccgctgatggcgtctggcaagtcactgccctgctttgagccttatgagttcacccccagggctggtggctttgtcactggcaggttcctcaccggcatcaaacctcctgagttcttcttccactgcatggcaggacgagagggcctggtggacactgctgtgaaaaccagccgctcaggctatctccaaaggtgcatcatcaagcacctagaggggctggtcgtgcagtatgatctcacggtccgtgacagtgacggcagtgtggtgcagttcctgtatggggaggatggcctggacatccccaagacacagttcctgcagcccaagcagttccccttcctggccagcaactacgaggtgataatgaaatcacagcatctccatgaagttttatccagagcagatcccaaaaaagctctccaccacttcagagctatcaaaaaatggcaaagcaagcaccccaacaccctgctgagaagaggcgccttcttgagttattcccagaaaattcaggaagctgtgaaagccctgaaacttgagagtgaaaaccgcaatggccgcagccctgggactcaggagatgctgaggatgtggtatgagttggatgaggaaagccgaaggaaataccagaagaaggcggccgcttgtcctgaccccagtctgtctgtctggcgtcctgacatctactttgcatcagtgtcagaaacatttgaaacaaaggttgatgactacagtcaagagtgggcagctcaaacagagaagagttatgagaaatcagagctttctctcgacaggttgaggaccttgctgcagctgaagtggcagcgctcactgtgtgagccgggcgaggctgtgggcctgctggctgcccagagcatcggagagccctccacccagatgaccctcaacaccttccactttgcaggcagaggcgagatgaacgtcaccctgggcattccaaggttgcgggagattctcatggtggccagcgccaacatcaagacacccatgatgagcgtgcccgtgctcaacaccaagaaagccctgaagagagtgaaaagcctgaagaagcaactcaccagggtgtgcttgggggaggtgttgcagaaaattgacgtccaggagtccttctgtatggaagaaaaacagaacaaattccaggtgtaccagctgcggtttcagttcctgccacatgcatattaccagcaggagaagtgcctgagacccgaggacatcctgcgcttcatggaaacaagattctttaaacttctgatggaatccatcaaaaagaagaataataaagcatcagctttcaggaacgtaaacactcgaagagctacacagcgggatctggacaacgctggggagttggggaggagtcggggagagcaggagggtgatgaggaagaggaggggcacattgtggatgctgaagctgaggagggggacgccgatgcctctgatgccaaacgcaaggagaagcaggaggaggaggttgattatgagagtgaggaagaggaggagagggagggcgaggagaacgacgatgaagacatgcaggaggaacgaaatccccacagggaaggtgctcgaaagacccaagagcaagatgaagaggtgacagtgaagctccctctgatgaagatcaactttgacatgagctccctggtagtatctttggcccatggtgccgtcatctatgcgaccaagggcatcactcggtgcctcctgaatgaaacaaccaacaataagaacgagaaggagcttgtgctaaacacagaaggaatcaacctcccagagctattcaagtatgcagaggtcctggatctgcgccgcctctactccaacgacatccacgccatagccaacacgtatggcattgaggccgcgctgcgggtgatcgagaaggagatcaaggatgtgtttgccgtgtatggcatcgcggtcgaccctcgccatctctccctggttgctgattatatgtgcttcgagggtgtttacaagccactgaatcgctttgggatccggtcaaactcttccccgctacagcagatgacatttgaaaccagcttccagtttctgaagcaagccaccatgctgggatcccacgatgagctgaggtctccttctgcctgccttgtggtcgggaaggtcgtcaggggcgggacaggcctgttcgagctcaagcagcctctgagatagcagctaccccggcaccatctgcccagctccaaggacccttggtgagggcgtggcccagcctgccttctgcatgagaggaccaggagactggaatccagggcagttccaagtgacagtacagagcacagcagcgaccttgggcctgaaagcagtgggcctctgagctgggccagcttcacctggaaagtgacagagttgctcatccttgcccctccctgtctctggatttttatcaaggtttaccaagtcttctgagtccccctgagatggctggggcctcacctgtgctgcaggaggcctctgtggcataacccctaaggagaagtcctgattcacgattcactgagaagaccaaggggaagccatgctttgctgctggggaccccaggcacctccagagtagggaagcggggttcttttgctgtgagtggccagggacaacagacaagattcctgggggctcccgatgagcaggaacgtggagcctgctgcccaaggcctgctccttccggctgctccagcccctgggggcagagtccacaaagagtccccatcaagacttcttccctgagtcaagtacagcgtagcatagtcctccacccacccaacctctctgcctggccagggtcctggccctgccactgtgtggcgaggtgtccttctagaccacatcagccccaaggctgggagcagtcgctccagggccgcagcagttcactcccacacatagaacccaggtcactgctggggcgattgaacaggttgcctggcttttctctgctgtcagtttggtgtggaggcctatgttctgccccatacaccccacaggccctgcttatgggaaggaacacaggcctccagcccagaggactgtgccgccctgttcttggccgtccacgtttcctctccctctagcaccagcaatacatttccctggcatggacagaaaagacagagaggacttatacaaaggctttgtaaaaccagaggctagcttctatctttgtctactgttatttcagctcagggcgggtaattaacatcattggaactagctattaggaaagaaaaaaaacttggttttttttacaacaa

SEQ ID NO: 167469 - DNA, 560 bp, Homo sapiens
  Payload ID: 12946
  Gene Symbol: POLR1A
  Gene Name: polymerase (RNA) I polypeptide A, 194kDa
  ENST ID: ENST00000409024
  CDS Start-End: 99-227
aatcgcgtggtgactccgggcttgaggttgaattaagaatagtcaggtggtgagtggaacgtctcttggggtgtcggaattcaaaacggacctggaggatgttgatctccaagaacatgccctggcggcggctgcagggcatttccttcgggatgtattcggctgaagagctcaatttctggaagaaaatcccgatccctctgcctctgaaattcgggaggaattagaacaatacacaactgaaattgtgcagaacaacctcctggggtcccagggcgcacatgtaaagaacgtgtgtgagagcaagagcaagctcattgctctcttctggaaggcacatatgaatgctaagcgctgtccccactgcaagaccgggcgatccgttgtccgaaaggaacacaacagcaagttgactatcacgtttccagccatggtgcacaggacagctggccagaaggactctgagcccctgggaattgaggaagctcagataggaaaacgaggatacttaacacccaccagtgcccgcgaacacctttctgccctgtggaagaatgaag

SEQ ID NO: 167470 - DNA, 576 bp, Homo sapiens
  Payload ID: 12946
  Gene Symbol: POLR1A
  Gene Name: polymerase (RNA) I polypeptide A, 194kDa
  ENST ID: ENST00000424089
  CDS Start-End: 111-239
aagcgcacgttgaatcgcgtggtgactccgggcttgaggttgaattaagaatagtcaggtggtgagtggaacgtctcttggggtgtcggaattcaaaacggacctggaggatgttgatctccaagaacatgccctggcggcggctgcagggcatttccttcgggatgtattcggctgaagagctcaatttctggaagaaaatcccgatccctctgcctctgaaattcgggaggaattagaacaatacacaactgaaattgtgcagaacaacctcctggggtcccagggcgcacatgaccgggcgatccgttgtccgaaaggaacacaacagcaagttgactatcacgtttccagccatggtgcacaggacagctggccagaaggactctgagcccctgggaattgaggaagctcagataggaaaacgaggatacttaacacccaccagtgcccgcgaacacctttctgccctgtggaagaatgaaggattctttctgaactaccttttttcgggaatggatgatgatggtatggaatccagattcaatcccagtgtgttctttctagatttcttgg

SEQ ID NO: 167471 - DNA, 4558 bp, Homo sapiens
  Payload ID: 12947
  Gene Symbol: POLR1B
  Gene Name: polymerase (RNA) I polypeptide B, 128kDa
  Uniprot ID: Q9H9Y6
  ENST ID: ENST00000263331
  CDS Start-End: 581-3988
agatgcgacgaggttagcggggcccgaccactccttggcttcccaggggtgagcctcgcgagttaggagttgggtagagagtcagcccggggcccggcatccgctttttcgttgaagcaacgactttggccggatgactccccagggtcggcatcagcgtgggactgggaacaggtgaagggaaacagaagagagcctgagaagaccgctctcctccgatcctaattgactgagccaatgagagccaaagaggtcacatgctcaactgggcggggagcgggtttccacctgcggcatctttcgcgagcggggagatgagtggggcggaatatgggagaaagggagggcccgccacgctctggctggacacggccttaatcggcccgttcactcgacgtttttggttctacgttgaccccgagaaaccgaaaccgcagggcctagggcgggtggaacgagagggaactacatttcccagcaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctatacctccctttgaatttgctttcaaagatgagcgtatctcttttactattctggatgctgttatcagtccacctacagttccaaaagggaccatctgcaaagaggccaatgtttatccagcagaatgccggggccgaaggagtacctaccgtgggaagttgacagctgatatcaactgggcagtgaatggaatctcaaaaggaatcattaagcagtttcttggctatgttcccatcatggtgaaatccaagctttgcaacttacgtaaccttcccccacaagccctcattgagcaccatgaggaggcagaggaaatggggggctattttataatcaatggcattgaaaaagtcatccgaatgttgattatgcctcggagaaattttcccattgcaatgataagaccaaaatggaaaaccagagggcctggttatactcagtatggagtttcaatgcactgtgtgagggaagaacattccgctgtcaatatgaacctccactacttggaaaatggcactgttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgttcgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggaaaaactggaaggttggttagtgtctattaaaatagcttttgataagaaggctcagaagaccagtgtttccatgaacactgacaatttgatgaggatttttacaatgggcatagaccttacaaaaccatttgaatacctttttgctactgggaatctgcgttctaaaacaggtcttggcctcctacaagattctggactttgtgttgtggctgacaagctgaacttcatacgctacctctcccatttccgctgcgtgcacagaggggctgattttgccaagatgaggaccaccacagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctccacaa

SEQ ID NO: 167472 - DNA, 4376 bp, Homo sapiens
  Payload ID: 12947
  Gene Symbol: POLR1B
  Gene Name: polymerase (RNA) I polypeptide B, 128kDa
  ENST ID: ENST00000333990
  CDS Start-End: 307-528
gagcgggtttccacctgcggcatctttcgcgagcggggagatgagtggggcggaatatgggagaaagggagggcccgccacgctctggctggacacggccttaatcggcccgttcactcgacgtttttggttctacgttgaccccgagaaaccgaaaccgcagggcctagggcgggtggaacgagagggaactacatttcccagcaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcagagacggggtctccctatgtggcccagcctggtctcaaactcctgagctcaagtagtcctcctctctcggtctcccaaatattgggattacaggctatacctccctttgaatttgctttcaaagatgagcgtatctcttttactattctggatgctgttatcagtccacctacagttccaaaagggaccatctgcaaagaggccaatgtttatccagcagaatgccggggccgaaggagtacctaccgtgggaagttgacagctgatatcaactgggcagtgaatggaatctcaaaaggaatcattaagcagtttcttggctatgttcccatcatggtgaaatccaagctttgcaacttacgtaaccttcccccacaagccctcattgagcaccatgaggaggcagaggaaatggggggctattttataatcaatggcattgaaaaagtcatccgaatgttgattatgcctcggagaaattttcccattgcaatgataagaccaaaatggaaaaccagagggcctggttatactcagtatggagtttcaatgcactgtgtgagggaagaacattccgctgtcaatatgaacctccactacttggaaaatggcactgttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgttcgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggaaaaactggaaggttggttagtgtctattaaaatagcttttgataagaaggctcagaagaccagtgtttccatgaacactgacaatttgatgaggatttttacaatgggcatagaccttacaaaaccatttgaatacctttttgctactgggaatctgcgttctaaaacaggtcttggcctcctacaagattctggactttgtgttgtggctgacaagctgaacttcatacgctacctctcccatttccgctgcgtgcacagaggggctgattttgccaagatgaggaccaccacagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctccacaa

SEQ ID NO: 167473 - DNA, 4457 bp, Homo sapiens
  Payload ID: 12947
  Gene Symbol: POLR1B
  Gene Name: polymerase (RNA) I polypeptide B, 128kDa
  Uniprot ID: Q9H9Y6
  ENST ID: ENST00000409894
  CDS Start-End: 270-3128
gagatgagtggggcggaatatgggagaaagggagggcccgccacgctctggctggacacggccttaatcggcccgttcactcgacgtttttggttctacgttgaccccgagaaaccgaaaccgcagggcctagggcgggtggaacgagagggaactacatttcccagcaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctatacctccctttgaatttgctttcaaagatgagcgtatctcttttactattctggatgctgttatcagtccacctacagttccaaaagggaccatctgcaaagaggccaatgtttatccagcagaatgccggggccgaaggagtacctaccgtgggaagttgacagctgatatcaactgggcagtgaatggaatctcaaaaggaatcattaagcagtttcttggctatgttcccatcatggtgaaatccaagctttgcaacttacgtaaccttcccccacaagccctcattgagcaccatgaggaggcagaggaaatggggggctattttataatcaatggcattgaaaaagtcatccgaatgttgattatgcctcggagaaattttcccattgcaatgataagaccaaaatggaaaaccagagggcctggttatactcagtatggagtttcaatgcactgtgtgagggaagaacattccgctgtcaatatgaacctccactacttggaaaatggcactgttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgttcgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggggtcactcccattgatggagctccccaccgatcatacagtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctccacaagtttcctcctgcccctttgttttttgctttttggttgctgttgagtttttgttttgtcttctgtggtaagaacacttaactcaagacctaccctcttaacaaatctttaagtgcacgatatagtattgttaattccaggcaccatgttgtacaacagatctttagaccttacttgtcttgcataactgaagctttatacctgttgaacaactctccatttccctggcccctagcaaccacccttctaccctgtttctatgagtttgactattacagatatctcatatagtgggatcatgcaatatttgtcctgtgactggcttatttcacttagcatagtgaaataagattcatccattttggaagccaggcatggtgctgtgcatctatagtccctgctatttgagaggctgaggtgggaggatcatttgagtgcaggagttcaaggacagcctgggtaatataggaagaccctgtcttgaagaccctgacctcaagtgatccacccacctcggcctccgaaagtgctaggattacaggtgtgagccactgtgcctggcctccggtgagtattttatatttagtctacacttccatacttggcttttttctgcttttatattgatctgctttcatagcagtgtgtagagtgccacttatgttttctttcttgtgtacagtattttattgtatggatttaccatcccctgtgtatttaagttgttccattctttggccattataacttttttctgcaaa

SEQ ID NO: 167474 - DNA, 555 bp, Homo sapiens
  Payload ID: 12947
  Gene Symbol: POLR1B
  Gene Name: polymerase (RNA) I polypeptide B, 128kDa
  ENST ID: ENST00000438748
  CDS Start-End: 170-555
tttttcgttgaagcaacgactttggccggatgactccccagggtcggcatcagcgtgggactgggaacaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctatacctccctttgaatttgctttcaaagatgagcgtatctcttttactattctggatgctgttatcagtccacctacagttccaaaagggaccatctgcaaagaggccaatgtttatccagcagaatgccggggccgaaggagtacctaccgtgggaagttgacagctgatatcaactgggcagtgaatggaatctcaaaaggaat

SEQ ID NO: 167475 - DNA, 2494 bp, Homo sapiens
  Payload ID: 12947
  Gene Symbol: POLR1B
  Gene Name: polymerase (RNA) I polypeptide B, 128kDa
  ENST ID: ENST00000448770
  CDS Start-End: 222-539
tggctggacacggccttaatcggcccgttcactcgacgtttttggttctacgttgaccccgagaaaccgaaaccgcagggcctagggcgggtggaacgagagggaactacatttcccagcaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccct

SEQ ID NO: 167476 - DNA, 558 bp, Homo sapiens
  Payload ID: 12947
  Gene Symbol: POLR1B
  Gene Name: polymerase (RNA) I polypeptide B, 128kDa
  ENST ID: ENST00000424062
  CDS Start-End: 46-324
tccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcagtccacctacagttccaaaagggaccatctgcaaagaggccaatgtttatccagcagaatgccggggccgaaggagtacctaccgtgggaagttgacagctgatatcaactgggcagtgaatggaatctcaaaaggaatcattaagcagtttcttggctatgttcccatcatggtgaaatccaagctttgcaacttacgtaaccttcccccacaagccctcattgagcaccatgaggaggcagaggaaatggggggctattttataatcaatggcattgaaaaagtcatccgaatgttgattatgcctcggagaaattttcccattgcaatgataag

SEQ ID NO: 167477 - DNA, 923 bp, Homo sapiens
  Payload ID: 12947
  Gene Symbol: POLR1B
  Gene Name: polymerase (RNA) I polypeptide B, 128kDa
  ENST ID: ENST00000458012
  CDS Start-End: 1-923
ccaggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccg

SEQ ID NO: 167478 - DNA, 595 bp, Homo sapiens
  Payload ID: 12947
  Gene Symbol: POLR1B
  Gene Name: polymerase (RNA) I polypeptide B, 128kDa
  ENST ID: ENST00000430293
  CDS Start-End: 77-274
actacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggagtttcaatgcactgtgtgagggaagaacattccgctgtcaatatgaacctccactacttggaaaatggcactgttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgttcgacacaaaaacaggtccttaactacctaggtgaatgcttcagagtaaaactcaatgttcctgactggtacccaaatgagcaag

SEQ ID NO: 167479 - DNA, 3836 bp, Homo sapiens
  Payload ID: 12947
  Gene Symbol: POLR1B
  Gene Name: polymerase (RNA) I polypeptide B, 128kDa
  Uniprot ID: Q9H9Y6
  ENST ID: ENST00000417433
  CDS Start-End: 31-3270
gagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctgatatcaactgggcagtgaatggaatctcaaaaggaatcattaagcagtttcttggctatgttcccatcatggtgaaatccaagctttgcaacttacgtaaccttcccccacaagccctcattgagcaccatgaggaggcagaggaaatggggggctattttataatcaatggcattgaaaaagtcatccgaatgttgattatgcctcggagaaattttcccattgcaatgataagaccaaaatggaaaaccagagggcctggttatactcagtatggagtttcaatgcactgtgtgagggaagaacattccgctgtcaatatgaacctccactacttggaaaatggcactgttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgttcgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggaaaaactggaaggttggttagtgtctattaaaatagcttttgataagaaggctcagaagaccagtgtttccatgaacactgacaatttgatgaggatttttacaatgggcatagaccttacaaaaccatttgaatacctttttgctactgggaatctgcgttctaaaacaggtcttggcctcctacaagattctggactttgtgttgtggctgacaagctgaacttcatacgctacctctcccatttccgctgcgtgcacagaggggctgattttgccaagatgaggaccaccacagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctcc

SEQ ID NO: 167480 - DNA, 572 bp, Homo sapiens
  Payload ID: 12947
  Gene Symbol: POLR1B
  Gene Name: polymerase (RNA) I polypeptide B, 128kDa
  ENST ID: ENST00000430769
  CDS Start-End: 231-572
gactttggccggatgactccccagggtcggcatcagcgtgggactgggaacaggtgaagggaaacagaagagagcctgagaagaccgctctcctccgatcctaattgactgagccaatgagagccaaagaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctatacctccctttgaatttgctttcaaagatgagcgtatctcttttactattctggatgctgttatcagtccacctacagttccaaaagggaccatctgcaaagaggccaatgtttatccagcagaatgccggggccgaaggagtacctaccgtgggaagttg

SEQ ID NO: 167481 - DNA, 4961 bp, Homo sapiens
  Payload ID: 12947
  Gene Symbol: POLR1B
  Gene Name: polymerase (RNA) I polypeptide B, 128kDa
  Uniprot ID: Q9H9Y6
  ENST ID: ENST00000537335
  CDS Start-End: 766-3540
agatgcgacgaggttagcggggcccgaccactccttggcttcccaggggtgagcctcgcgagttaggagttgggtagagagtcagcccggggcccggcatccgctttttcgttgaagcaacgactttggccggatgactccccagggtcggcatcagcgtgggactgggaacaggtgaagggaaacagaagagagcctgagaagaccgctctcctccgatcctaattgactgagccaatgagagccaaagaggtcacatgctcaactgggcggggagcgggtttccacctgcggcatctttcgcgagcggggagatgagtggggcggaatatgggagaaagggagggcccgccacgctctggctggacacggccttaatcggcccgttcactcgacgtttttggttctacgttgaccccgagaaaccgaaaccgcagggcctagggcgggtggaacgagagggaactacatttcccagcaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggagtttcaatgcactgtgtgagggaagaacattccgctgtcaatatgaacctccactacttggaaaatggcactgttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgttcgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggaaaaactggaaggttggttagtgtctattaaaatagcttttgataagaaggctcagaagaccagtgtttccatgaacactgacaatttgatgaggatttttacaatgggcatagaccttacaaaaccatttgaatacctttttgctactgggaatctgcgttctaaaacaggtcttggcctcctacaagattctggactttgtgttgtggctgacaagctgaacttcatacgctacctctcccatttccgctgcgtgcacagaggggctgattttgccaagatgaggaccaccacagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctccacaagtttcctcctgcccctttgttttttgctttttggttgctgttgagtttttgttttgtcttctgtggtaagaacacttaactcaagacctaccctcttaacaaatctttaagtgcacgatatagtattgttaattccaggcaccatgttgtacaacagatctttagaccttacttgtcttgcataactgaagctttatacctgttgaacaactctccatttccctggcccctagcaaccacccttctaccctgtttctatgagtttgactattacagatatctcatatagtgggatcatgcaatatttgtcctgtgactggcttatttcacttagcatagtgaaataagattcatccattttggaagccaggcatggtgctgtgcatctatagtccctgctatttgagaggctgaggtgggaggatcatttgagtgcaggagttcaaggacagcctgggtaatataggaagaccctgtcttgaagaccctgacctcaagtgatccacccacctcggcctccgaaagtgctaggattacaggtgtgagccactgtgcctggcctccggtgagtattttatatttagtctacacttccatacttggcttttttctgcttttatattgatctgctttcatagcagtgtgtagagtgccacttatgttttctttcttgtgtacagtattttattgtatggatttaccatcccctgtgtatttaagttgttccattctttggccattataacttttttctgcaaatattctggtgacttatctttggccattataaactgttgataatagatcatcttgtatatacttctgcaattataagatgttttttgatgatg

SEQ ID NO: 167482 - DNA, 5059 bp, Homo sapiens
  Payload ID: 12947
  Gene Symbol: POLR1B
  Gene Name: polymerase (RNA) I polypeptide B, 128kDa
  Uniprot ID: Q9H9Y6
  ENST ID: ENST00000541869
  CDS Start-End: 117-3638
gactttggccggatgactccccagggtcggcatcagcgtgggactgggaacaggtgaagggaaacagaagagagcctgagaagaccgctctcctccgatcctaattgactgagccaatgagagccaaagaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctatacctccctttgaatttgctttcaaagatgagcgtatctcttttactattctggatgctgttatcagtccacctacagttccaaaagggaccatctgcaaagaggccaatgtttatccagcagaatgccggggccgaaggagtacctaccgtgggaagttgacagctgatatcaactgggcagtgaatggaatctcaaaaggaatcattaagcagtttcttggctatgttcccatcatggtgaaatccaagctttgcaacttacgtaaccttcccccacaagccctcattgagcaccatgaggaggcagaggaaatggggggctattttataatcaatggcattgaaaaagtcatccgaatgttgattatgcctcggagaaattttcccattgcaatgataagaccaaaatggaaaaccagagggcctggttatactcagtatggagtttcaatgcactgtgtgagggaagaacattccgctgtcaatatgaacctccactacttggaaaatggcactgttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgttcgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggaaaaactggaaggttggttagtgtctattaaaatagcttttgataagaaggctcagaagaccagtgtttccatgaacactgacaatttgatgaggatttttacaatgggcatagaccttacaaaaccatttgaatacctttttgctactgggaatctgcgttctaaaacaggtcttggcctcctacaagattctggactttgtgttgtggctgacaagctgaacttcatacgctacctctcccatttccgctgcgtgcacagaggggctgattttgccaagatgaggaccaccacagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctccacaagtttcctcctgcccctttgttttttgctttttggttgctgttgagtttttgttttgtcttctgtggtaagaacacttaactcaagacctaccctcttaacaaatctttaagtgcacgatatagtattgttaattccaggcaccatgttgtacaacagatctttagaccttacttgtcttgcataactgaagctttatacctgttgaacaactctccatttccctggcccctagcaaccacccttctaccctgtttctatgagtttgactattacagatatctcatatagtgggatcatgcaatatttgtcctgtgactggcttatttcacttagcatagtgaaataagattcatccattttggaagccaggcatggtgctgtgcatctatagtccctgctatttgagaggctgaggtgggaggatcatttgagtgcaggagttcaaggacagcctgggtaatataggaagaccctgtcttgaagaccctgacctcaagtgatccacccacctcggcctccgaaagtgctaggattacaggtgtgagccactgtgcctggcctccggtgagtattttatatttagtctacacttccatacttggcttttttctgcttttatattgatctgctttcatagcagtgtgtagagtgccacttatgttttctttcttgtgtacagtattttattgtatggatttaccatcccctgtgtatttaagttgttccattctttggccattataacttttttctgcaaatattctggtgacttatctttggccattataaactgttgataatagatcatcttgtatatacttctgcaattataagatgttttttgatgatg

SEQ ID NO: 167483 - DNA, 1280 bp, Homo sapiens
  Payload ID: 12948
  Gene Symbol: POLR1C
  Gene Name: polymerase (RNA) I polypeptide C, 30kDa
  Uniprot ID: O15160
  ENST ID: ENST00000304004
  CDS Start-End: 22-1050
agtctcgtggagagattgaagatggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggcaaagatcatgccaagttttcaccagtggcaacagccagttacaggctcctgccagacatcaccctgcttgagcccgtggaaggggaggcagctgaggagttgagcaggtgcttctcacctggtgttattgaggtgcaggaagtccaaggtaaaaaggtggccagagttgccaacccccggctggataccttcagcagagaaatcttccggaatgagaagctaaagaaggttgtgaggcttgcccgggttcgagatcattatatctgtaagaaagatttgctggctgcggtggctcacacctgtaatcccagcactttgggaggccaaggcgagtggatcacggggtcaagagagcgagaccatcctggctaacatggtgaaaccccgtctctactaaaaaaaaaaaaaaaaaaaaaaaaaattagtcgggcatgggggcgagcgcctgtagtcccagctactcgagaagctaaggcaagagaatggtgtgaacctgggaggcgaagcttgcagtgagccgagatcacgccactgcactccagcctgggcaacagagcaagactccgtctcaaaaaaaaaaaaaaagaaaagaaagaaagaga

SEQ ID NO: 167484 - DNA, 1119 bp, Homo sapiens
  Payload ID: 12948
  Gene Symbol: POLR1C
  Gene Name: polymerase (RNA) I polypeptide C, 30kDa
  ENST ID: ENST00000372344
  CDS Start-End: 23-913
tagtctcgtggagagattgaagatggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggtaaaaaggtggccagagttgccaacccccggctggataccttcagcagagaaatcttccggaatgagaagctaaagaaggttgtgaggcttgcccgggttcgagatcattatatcttctctgttgagtcaacgggggtgttgccaccagatgtgctggtgagtgaagccatcaaagtactgatggggaagtgccggcgcttcttggatgaactagatgcggttcagatggactgagcttggatgcttctgaggcaagctgaagctttgggttctgactgacccaccctacaggactgctgaacagagagcccagtgtgactagggatcctgagttttctgggacaattccagctttaatcaatacattttgttaaatgtgccataaaatgagactttttacgcctttataaggccttagatgtaaataaactcacccaaac

SEQ ID NO: 167485 - DNA, 1355 bp, Homo sapiens
  Payload ID: 12948
  Gene Symbol: POLR1C
  Gene Name: polymerase (RNA) I polypeptide C, 30kDa
  Uniprot ID: O15160
  ENST ID: ENST00000372389
  CDS Start-End: 89-1129
aggaggcggtgcgttgccacggagacggagcagggctactaggacgcacgcgcgagatagaacctctagtctcgtggagagattgaagatggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggcaaagatcatgccaagttttcaccagtggcaacagccagttacaggctcctgccagacatcaccctgcttgagcccgtggaaggggaggcagctgaggagttgagcaggtgcttctcacctggtgttattgaggtgcaggaagtccaaggtaaaaaggtggccagagttgccaacccccggctggataccttcagcagagaaatcttccggaatgagaagctaaagaaggttgtgaggcttgcccgggttcgagatcattatatcttctctgttgagtcaacgggggtgttgccaccagatgtgctggtgagtgaagccatcaaagtactgatggggaagtgccggcgcttcttggatgaactagatgcggttcagatggactgagcttggatgcttctgaggcaagctgaagctttgggttctgactgacccaccctacaggactgctgaacagagagcccagtgtgactagggatcctgagttttctgggacaattccagctttaatcaatacattttgttaaatgtgccataaaatgagactttttacgcctttataaggccttagatgtaaataaactcacccaaacaaaaaaactttttgagacta

SEQ ID NO: 167486 - DNA, 576 bp, Homo sapiens
  Payload ID: 12948
  Gene Symbol: POLR1C
  Gene Name: polymerase (RNA) I polypeptide C, 30kDa
  ENST ID: ENST00000428025
  CDS Start-End: 204-576
gttgtcgcgaaggccgcggcagatgtcccgcacctcggcgccggacagcggctcccccgaaatctggatggagctgggcagcatcgtgcccacggctgggcctccgggtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctgggga

SEQ ID NO: 167487 - DNA, 418 bp, Homo sapiens
  Payload ID: 12948
  Gene Symbol: POLR1C
  Gene Name: polymerase (RNA) I polypeptide C, 30kDa
  ENST ID: ENST00000423780
  CDS Start-End: 1-418
ggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaagtgtataccaggcatatgacatggatccccctggggaac

SEQ ID NO: 167488 - DNA, 1166 bp, Homo sapiens
  Payload ID: 12949
  Gene Symbol: POLR1D
  Gene Name: polymerase (RNA) I polypeptide D, 16kDa
  Uniprot ID: Q9Y2S0
  ENST ID: ENST00000302979
  CDS Start-End: 563-964
cccctccctcttcaaggtgtgttgaccgactacagtttaagcctgtcgtcccacaaaaggcccgggagggccggggtcccaggaagggccatcctgggtcaacaccgccccagttgggaagtcgggccgctttcggacttgccactgggaagggaagtgatttgggggcggcaggtaaggccgcgccccttcgccatcacctggggaaaggtaccagagttgagccggggcgcccgcaggcctgtctgggcctcggggtaaggcggcgctggccccgccccctgcccctcccgccgcgagtggcctcgcgtggtcgcccaggtgagccgcggggccgcgagccaccgctcaccccgcgtcggggcgggggctgggggtggagcctcatgccccgccccgcggctgggccctgccgcgccgctgcggctcctcctccctccttccgtcctccgcgccttccgtcggtcggtccttgcttcctgcttcgcctccgcgcctcgcgctatgggacagagcccccgatccgccagcaccacctgaggatccagaaaccgccccagcgatggaagaggatcaggagctggagagaaaaatatctggattgaagacctcaatggctgaaggcgagaggaagacagccctggaaatggtccaggcagctggaacagatagacactgtgtgacatttgtattgcacgaggaagaccataccctaggaaattctctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtattcttctaataaattccctcttttatttaaacta

SEQ ID NO: 167489 - DNA, 668 bp, Homo sapiens
  Payload ID: 12949
  Gene Symbol: POLR1D
  Gene Name: polymerase (RNA) I polypeptide D, 16kDa
  ENST ID: ENST00000399696
  CDS Start-End: 116-466
ccacctgaggatccagaaaccgccccagcgatggaagaggatcaggagctggagagtatgatctcatttttataaaaaatatgtgtgtagaaaaatatctggattgaagacctcaatggctgaaggcgagaggaagacagccctggaaatggtccaggcagctggaacagatagacactgtgtgacatttgtattgcacgaggaagaccataccctaggaaattctctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtattcttctaataaattccctcttttatttaaacta

SEQ ID NO: 167490 - DNA, 2036 bp, Homo sapiens
  Payload ID: 12949
  Gene Symbol: POLR1D
  Gene Name: polymerase (RNA) I polypeptide D, 16kDa
  Uniprot ID: Q9Y2S0
  ENST ID: ENST00000399697
  CDS Start-End: 206-574
gtcggggcgggggctgggggtggagcctcatgccccgccccgcggctgggccctgccgcgccgctgcggctcctcctccctccttccgtcctccgcgccttccgtcggtcggtccttgcttcctgcttcgcctccgcgcctcgcgctatgggacagagcccccgatccgccagcaccacctgaggatccagaaaccgccccagcgatggaagaggatcaggagctggagaggaaagcaatagaagaactgcttaaggaggcaaaacgtgggaaaactagagctgaaacaatgggacccatgggttggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacagaagccatccttacaagcacagcttccgcgctcgaggttccgccagttactccccgccacgaaagcggagcagccaggacaagtacgaaaagcggtccaaccggcggtgaggctggaaccagggccagccagccctgcgggcctccgtgctccttcggggtgcggtgtgcggagaaggcctgagctggcagggcaaacacctgagagtgactttgacattaggtcctttgttgtttttaaagaggctgctggccacaggcaaaaaaaatgacctagcaactcttgaggaaacaagtgcaaaggaggatgtcttggcaagtttaagctacttctgcagtgtagtagacttacatattgttgtttatcttgtttggaagtgtgtttcaaaataaacatgtctagaatttaaagttttcagagattgttaaaactggttccaattttttggtcatttctcagaaaaataaaatacttataaatcctatattttactttttgggggtattacatttaaaatttagaaatcatcagtccagtgaccatatttatgaaaagctgtagccctccaaggtctgggaatttatcgagaagctctttgatagctctgcatttgttttcccttaggtgaacaatgtaggaaatcctcaaagtggctttgaatttaatgctccacttcagttaccagaggttaaaaatgggttttgttgtttcctgtgcattctcaaactcatttattagatagaacaatctttctatatttaatttttttaatatataggtcttaagtggtgctttaaaaagaaccctcacaagttaaaaattaagagttgtttcagtgctagatcttaccagctaaagacttgtgataccactatatagtatagttgttccagaaatcttcattttaaatagaagtgtttacaatgccttttttcccccagtattggttttcaatacctgttttcatatacaattacaaacctttcaaacctgtattccttctttatactcaggaaaatgtcaccaagcaccctcctccccagttcacaaaaggaagaagatgaagattctgtctccctgttccccctccccagttttccaaagtgtctgagcatatgcctggctgtcctcagatcatcaccatgccacatccctgctccctacttcctggcagccaagaaaagccctttctacatgctagaaggaaatacatccaaaaagttagcattggagtgttagaaactagaatagacctctccgccaccgagctgctgtgtcacgccctcagcctgctagggagtgacaagcccaagtcattcttgatccaccccttctcccaccccagatcccagggactcatcctgtgactttgtaaccacactcattcctttcaaacacagaggaggaattattgcttcatctgactttattcaaatctagttatgtattggcctaaattatttgtgcaaaatttgaaatgttttttatttaaatattagaaatagcacaaagtcatggagtttttaaaaattgttataattaagtaaaaataaagctgaattgtgtcatttg

SEQ ID NO: 167491 - DNA, 1606 bp, Homo sapiens
  Payload ID: 12949
  Gene Symbol: POLR1D
  Gene Name: polymerase (RNA) I polypeptide D, 16kDa
  ENST ID: ENST00000621089
  CDS Start-End: 253-537
gcagaaacgtagttgcgctggacagctggagtcgggcagggtcggggccagcggcgaggggacaagaagggccgattcgagaggaagcgcacctgagggagcacagcgaaggccgggacgcagggagctggatggagagcgagcctgggcggcgaaaggttgccgaggcgggggctgggcgcctgggaacaaaggaaagcaatagaagaactgcttaaggaggcaaaacgtgggaaaactagagctgaaacaatgggacccatgggttggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacagaagccatccttacaagcacagcttccgcgctcgaggttccgccagttactccccgccacgaaagcggagcagccaggacaagtacgaaaagcggtccaaccggcggtgaggctggaaccagggccagccagccctgcgggcctccgtgctccttcggggtgcggtgtgcggagaaggcctgagctggcagggcaaacacctgagagtgactttgacattaggtcctttgttgtttttaaagaggctgctggccacaggcaaaaaaaatgacctagcaactcttgaggaaacaagtgcaaaggaggatgtcttggcaagtttaagctacttctgcagtgtagtagacttacatattgttgtttatcttgtttggaagtgtgtttcaaaataaacatgtctagaatttaaagttttcagagattgttaaaactggttccaattttttggtcatttctcagaaaaataaaatacttataaatcctatattttactttttgggggtattacatttaaaatttagaaatcatcagtccagtgaccatatttatgaaaagctgtagccctccaaggtctgggaatttatcgagaagctctttgatagctctgcatttgttttcccttaggtgaacaatgtaggaaatcctcaaagtggctttgaatttaatgctccacttcagttaccagaggttaaaaatgggttttgttgtttcctgtgcattctcaaactcatttattagatagaacaatctttctatatttaatttttttaatatataggtcttaagtggtgctttaaaaagaaccctcacaagttaaaaattaagagttgtttcagtgctagatcttaccagctaaagacttgtgataccactatatagtatagttgttccagaaatcttcattttaaatagaagtgtttacaatgccttttttcccccagtattggttttcaatacctgttttcatatacaattacaaacctttcaaacctgtattccttctttatactcaggaaaatgtcaccaagcaccctcctccccagttcacaaaaggaagaagatgaagattctgtctccctgttccccctccccagttttccaaagtgtctgagcatatgcctggctgtcctcagatcatcaccatgccacatccctgctccctacttcctggcagccaag

SEQ ID NO: 167492 - DNA, 1723 bp, Homo sapiens
  Payload ID: 12949
  Gene Symbol: POLR1D
  Gene Name: polymerase (RNA) I polypeptide D, 16kDa
  ENST ID: ENST00000489647
  CDS Start-End: 115-243
tccgcgccttccgtcggtcggtccttgcttcctgcttcgcctccgcgcctcgcgctatgggacagagcccccgatccgccagcaccacctgaggatccagaaaccgccccagcgatggaagaggatcaggagctggagaggaaagcaatagaagaactgcttaaggaggcaaaacgtgggaaaactagagctgaaacaatgggacccatgggttgcttattacagggacaagatacaaactaaaatcagccaaaataagacacaaagattaaagccactgttatcctctgctccgtgaagaggacatgctaccctcccagcatcagtgtgtgataataagcatggaatattgccaagcaaggaagctcatctgcggctcagcattcaaagtttttattgcggtttcattaaataggtttgaagtcatgatatgctaccctcccagcatcagtgtgtgataataggcatggaatattgccaagcaaggaagctcacctgagcctcagtgttcaaagtttttattgaggtttcattacataggtttgattgatggatggatggatggatggatggattacatgactgatctcagtttccaggttgactgataccacgtaacccaaagctctcaccctaagtcacatgttagtctctctggcatggccagctcccactctaagactcttaggtgtgaccagctccaccctaaacaaagacatttctatgacattactttctggaagctaaggcaaaggccagccctctctttgggccaaaccaaactcttgactacatgggcaggaaatgtataagagaagctggaaaatcttgtcacaccagaaagcaaagaaactgtcaaagaccaatgtactcatttcagaaagactcaggacccacttgaaaggtctcccactagtcaaagatgatataatttgatttaaaaaacaaataaatgattaaaacacctaaaatatgttaaaatctgtaaggtcataatgataatcataataacaaacctggtagtcccttttataggatgctagagcaccaaatcactattcacaaaactgataaataggaagaagtaagcatttaccctgttccctgtacaaattatacttcaaagtcaccaattaattgatgaaagaaaactttacagaagaattgtaactaatatattagaaggattatagaataatattatcatcatttgagtttcaacacattcattaacccttataccacagaaagatgcaagaagagcaaaccaccacctctggggcatccttgtcaaaaaattgaacctgaatctgatcaagtctctagttagaactactagtttgcaagaaatacagagggcagagaaacatgttaaatgacaccataaggctgcaatcacaaaaatccaaaatgtgagaaatgctacaggacaaagaacccagtttctttaacaaatgaattgcaaggagaaaagaaagaagagtatgctgtgaattaatagatttgaggaacatcaaataaaatgggtaccttgtttgtgtctttatccaaactaactgtaaaaagttattcaacaattgagggtatttgatgatattaaggaactgatgttgattttttaggtgtgatagtattgctgttattttaatttttaaaagccattatcttttagaaatgtattctgatatatttatggatgaaattatataatgaaataatccaa

SEQ ID NO: 167493 - DNA, 565 bp, Homo sapiens
  Payload ID: 12949
  Gene Symbol: POLR1D
  Gene Name: polymerase (RNA) I polypeptide D, 16kDa
  ENST ID: ENST00000627604
  CDS Start-End: 558-565
actccgccctcgccgcccgcctcccccactcgccccgggctgtccccgccgcccgcctgattcccctgcggaagccccgctggctaggtgtctgcgcgcacccccggccgccgccaagagtggcacagctggggaaggagtgaacatccagaggaatcgcggggcggggtggggggaggccaggagaacaggtggcgcagggaagcagaaacgtagttgcgctggacagctggagtcgggcagggtcggggccagcggcgaggggacaagaagggccgattcgagaggaagcgcacctgagggagcacagcgaaggccgggacgcagggagctggatggagagcgagcctgggcggcgaaaggttgccgaggcgggggctgggcgcctgggaacaaagttgaaaatgcaactgcaagctccccggtgaaacaaataccgccttcaaccttcgtattctgtggtgactcatctcgcacgtgacccccctccctcttcaaggaaagcaatagaagaactgcttaaggaggcaaaacgtgggaaaactagagctgaaacaatgggacc

SEQ ID NO: 167494 - DNA, 1931 bp, Homo sapiens
  Payload ID: 12949
  Gene Symbol: POLR1D
  Gene Name: polymerase (RNA) I polypeptide D, 16kDa
  ENST ID: ENST00000630983
  CDS Start-End: 110-211
gccttccgtcggtcggtccttgcttcctgcttcgcctccgcgcctcgcgctatgggacagagcccccgatccgccagcaccacctgaggatccagaaaccgccccagcgatggaagaggatcaggagctggagaggaaagcaatagaagaactgcttaaggaggcaaaacgtgggaaaactagagctgaaacaatgggacccatgggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacagaagccatccttacaagcacagcttccgcgctcgaggttccgccagttactccccgccacgaaagcggagcagccaggacaagtacgaaaagcggtccaaccggcggtgaggctggaaccagggccagccagccctgcgggcctccgtgctccttcggggtgcggtgtgcggagaaggcctgagctggcagggcaaacacctgagagtgactttgacattaggtcctttgttgtttttaaagaggctgctggccacaggcaaaaaaaatgacctagcaactcttgaggaaacaagtgcaaaggaggatgtcttggcaagtttaagctacttctgcagtgtagtagacttacatattgttgtttatcttgtttggaagtgtgtttcaaaataaacatgtctagaatttaaagttttcagagattgttaaaactggttccaattttttggtcatttctcagaaaaataaaatacttataaatcctatattttactttttgggggtattacatttaaaatttagaaatcatcagtccagtgaccatatttatgaaaagctgtagccctccaaggtctgggaatttatcgagaagctctttgatagctctgcatttgttttcccttaggtgaacaatgtaggaaatcctcaaagtggctttgaatttaatgctccacttcagttaccagaggttaaaaatgggttttgttgtttcctgtgcattctcaaactcatttattagatagaacaatctttctatatttaatttttttaatatataggtcttaagtggtgctttaaaaagaaccctcacaagttaaaaattaagagttgtttcagtgctagatcttaccagctaaagacttgtgataccactatatagtatagttgttccagaaatcttcattttaaatagaagtgtttacaatgccttttttcccccagtattggttttcaatacctgttttcatatacaattacaaacctttcaaacctgtattccttctttatactcaggaaaatgtcaccaagcaccctcctccccagttcacaaaaggaagaagatgaagattctgtctccctgttccccctccccagttttccaaagtgtctgagcatatgcctggctgtcctcagatcatcaccatgccacatccctgctccctacttcctggcagccaagaaaagccctttctacatgctagaaggaaatacatccaaaaagttagcattggagtgttagaaactagaatagacctctccgccaccgagctgctgtgtcacgccctcagcctgctagggagtgacaagcccaagtcattcttgatccaccccttctcccaccccagatcccagggactcatcctgtgactttgtaaccacactcattcctttcaaacacagaggaggaattattgcttcatctgactttattcaaatctagttatgtattggcctaaattatttgtgcaaaatttgaaatgttttttatttaaatattagaaatagcacaaagtcatggagtttttaaaaattgttataattaagtaaaaataaagctgaattgtgtc

SEQ ID NO: 167495 - DNA, 2118 bp, Homo sapiens
  Payload ID: 12949
  Gene Symbol: POLR1D
  Gene Name: polymerase (RNA) I polypeptide D, 16kDa
  ENST ID: ENST00000465887
  CDS Start-End: 93-221
ccttgcttcctgcttcgcctccgcgcctcgcgctatgggacagagcccccgatccgccagcaccacctgaggatccagaaaccgccccagcgatggaagaggatcaggagctggagaggaaagcaatagaagaactgcttaaggaggcaaaacgtgggaaaactagagctgaaacaatgggacccatgggttgcttattacagggacaagatacaaactaaaatcagccaaaataagacacaaagattaaagccactgttatcctctgctccgtgaagaggacatgctaccctcccagcatcagtgtgtgataataagcatggaatattgccaagcaaggaagctcatctgcggctcagcattcaaagtttttattgcggtttcattaaataggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacagaagccatccttacaagcacagcttccgcgctcgaggttccgccagttactccccgccacgaaagcggagcagccaggacaagtacgaaaagcggtccaaccggcggtgaggctggaaccagggccagccagccctgcgggcctccgtgctccttcggggtgcggtgtgcggagaaggcctgagctggcagggcaaacacctgagagtgactttgacattaggtcctttgttgtttttaaagaggctgctggccacaggcaaaaaaaatgacctagcaactcttgaggaaacaagtgcaaaggaggatgtcttggcaagtttaagctacttctgcagtgtagtagacttacatattgttgtttatcttgtttggaagtgtgtttcaaaataaacatgtctagaatttaaagttttcagagattgttaaaactggttccaattttttggtcatttctcagaaaaataaaatacttataaatcctatattttactttttgggggtattacatttaaaatttagaaatcatcagtccagtgaccatatttatgaaaagctgtagccctccaaggtctgggaatttatcgagaagctctttgatagctctgcatttgttttcccttaggtgaacaatgtaggaaatcctcaaagtggctttgaatttaatgctccacttcagttaccagaggttaaaaatgggttttgttgtttcctgtgcattctcaaactcatttattagatagaacaatctttctatatttaatttttttaatatataggtcttaagtggtgctttaaaaagaaccctcacaagttaaaaattaagagttgtttcagtgctagatcttaccagctaaagacttgtgataccactatatagtatagttgttccagaaatcttcattttaaatagaagtgtttacaatgccttttttcccccagtattggttttcaatacctgttttcatatacaattacaaacctttcaaacctgtattccttctttatactcaggaaaatgtcaccaagcaccctcctccccagttcacaaaaggaagaagatgaagattctgtctccctgttccccctccccagttttccaaagtgtctgagcatatgcctggctgtcctcagatcatcaccatgccacatccctgctccctacttcctggcagccaagaaaagccctttctacatgctagaaggaaatacatccaaaaagttagcattggagtgttagaaactagaatagacctctccgccaccgagctgctgtgtcacgccctcagcctgctagggagtgacaagcccaagtcattcttgatccaccccttctcccaccccagatcccagggactcatcctgtgactttgtaaccacactcattcctttcaaacacagaggaggaattattgcttcatctgactttattcaaatctagttatgtattggcctaaattatttgtgcaaaatttgaaatgttttttatttaaatattagaaatagcacaaagtcatggagtttttaaaaattgttataattaagtaaaaataaagctgaattgtgtc

SEQ ID NO: 167496 - DNA, 2229 bp, Homo sapiens
  Payload ID: 12950
  Gene Symbol: POLR1E
  Gene Name: polymerase (RNA) I polypeptide E, 53kDa
  Uniprot ID: Q9GZS1
  ENST ID: ENST00000377792
  CDS Start-End: 289-1734
ctctaaccctctccccttccgtctcggtacctcagctgtcctctcgccctccgttgggcttctccccagcggggccgggacccctctagtctccaccactcccctgggctctgtcagggctcccctgtccgtctttctgtcactacctcccagccagattgggacatcccactcacccgctccccagagctgtgtccaggaccctgctgaccccctcacccaccaggtctcccgcctcccccatttccctctcttcactgggcaggggttccttctgtcactttaggtatgtaccaggcctctgctgtcagcctccttccgcgagacattccctcctgtcacagcccctccccagggttctcccacctccctacctcctcttctcagctggccccggatctcctccagttccctttgggtcaggacccgagcttccttgccatccccattctgacactccctcccagtgacagtctagtcccaccgtacattgtgtggtacattgtgtggccttctgctctcatctcattcttgggctgcactcttacagtccagttctccaacgggaagctacagagtccaggcaacatgcgctttaccttgtatgagaacaaagattccaccaaccccaggaagaggaatcaacggatcctggcagctgaaacagataggctctcctatgtgggaaacaattttgggactggagccctcaaatgcaacactttgtgcaggcactttgtgggaattttgaacaagacctctggccaaatggaagtatatgatgctgaattgttcaacatgcagccactattttcagatgtatcagttgagagtgaactggcgctagagagtcagaccaaaacttacagagaaaagatggattcttgtattgaagcctttggtaccaccaaacagaagcgagctctgaacaccaggagaatgaacagagttggcaatgaatctttgaatcgtgcagtggctaaagctgcagagactatcattgatacgaagggtgtgactgctctggtcagcgatgctatccacaatgacttgcaagatgactccctctaccttcctccctgctatgatgatgcagccaagcctgaagacgtgtataaatttgaagatcttctttcccctgcggagtatgaagctcttcagagcccatctgaagctttcaggaacgtcacgtcagaagaaatactgaagatgattgaggagaacagccattgcacctttgtcatagaagcgttgaagtctttgccatcagatgtggagagccgagaccgccaggcccgatgcatatggtttctggataccctcatcaaatttcgagctcatagggtagttaagcggaaaagtgctctgggacctggagttccccacatcatcaacaccaaactgctgaagcactttacttgcttgacctacaacaatggcagattacggaacttaatttcggattctatgaaggcgaagattactgcatatgtgatcatacttgccttgcacatacatgacttccaaattgacctgacagtgttacagagggacttgaagctcagtgagaaaaggatgatggagatagccaaagccatgaggctgaagatctccaaaagaagggtgtctgtggccgccggcagtgaagaagatcacaagctgggcaccctgtccctcccgctgcctccagcccagacctcagaccgcctggcaaagcggaggaagattacctagacgcatgctttccagacagggcgttttggctgcatcacagccactggctggtcctattcatttccatttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggaggaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctgggtcacagagtgagaccttgtctcaaaaaagtaacataaggaaaaaagaagccttgctttagcacaggtatgaagccagaagccagcatctcaactgtgcttgtcttatgcagaaatataaagcgatggccaggttggacttca

SEQ ID NO: 167497 - DNA, 1868 bp, Homo sapiens
  Payload ID: 12950
  Gene Symbol: POLR1E
  Gene Name: polymerase (RNA) I polypeptide E, 53kDa
  Uniprot ID: Q9GZS1
  ENST ID: ENST00000377798
  CDS Start-End: 114-1373
ggcggggccacgccttttccggcccgcagcgcggcctgggctcccgcgtgtttaaaagtgcgcttgtggctgctgctgtcttaactcctgtgcttggcggacagacaggcgagatggcggcggaggtgttgccgagtgcgaggtggcagtattgtggggcgcccgacgggagccagagagctgtactggtccagttctccaacgggaagctacagagtccaggcaacatgcgctttaccttgtatgagaacaaagattccaccaaccccaggaagaggaatcaacggatcctggcagctgaaacagataggctctcctatgtgggaaacaattttgggactggagccctcaaatgcaacactttgtgcaggcactttgtgggaattttgaacaagacctctggccaaatggaagtatatgatgctgaattgttcaacatgcagccactattttcagatgtatcagttgagagtgaactggcgctagagagtcagaccaaaacttacagagaaaagatggattcttgtattgaagcctttggtaccaccaaacagaagcgagctctgaacaccaggagaatgaacagagttggcaatgaatctttgaatcgtgcagtggctaaagctgcagagactatcattgatacgaagggtgtgactgctctggtcagcgatgctatccacaatgacttgcaagatgactccctctaccttcctccctgctatgatgatgcagccaagcctgaagacgtgtataaatttgaagatcttctttcccctgcggagtatgaagctcttcagagcccatctgaagctttcaggaacgtcacgtcagaagaaatactgaagatgattgaggagaacagccattgcacctttgtcatagaagcgttgaagtctttgccatcagatgtggagagccgagaccgccaggcccgatgcatatggtttctggataccctcatcaaatttcgagctcatagggtagttaagcggaaaagtgctctgggacctggagttccccacatcatcaacaccaaactgctgaagcactttacttgcttgacctacaacaatggcagattacggaacttaatttcggattctatgaaggcgaagattactgcatatgtgatcatacttgccttgcacatacatgacttccaaattgacctgacagtgttacagagggacttgaagctcagtgagaaaaggatgatggagatagccaaagccatgaggctgaagatctccaaaagaagggtgtctgtggccgccggcagtgaagaagatcacaagctgggcaccctgtccctcccgctgcctccagcccagacctcagaccgcctggcaaagcggaggaagattacctagacgcatgctttccagacagggcgttttggctgcatcacagccactggctggtcctattcatttccatttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggaggaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctgggtcacagagtgagaccttgtctcaaaaaagtaacataaggaaaaaagaagccttgctttagcacaggtatgaagccagaagccagcatctcaactgtgcttgtcttatgcagaaatataaagcgatggccaggttggacttca

SEQ ID NO: 167498 - DNA, 1805 bp, Homo sapiens
  Payload ID: 12950
  Gene Symbol: POLR1E
  Gene Name: polymerase (RNA) I polypeptide E, 53kDa
  ENST ID: ENST00000442009
  CDS Start-End: 101-526
cttttccggcccgcagcgcggcctgggctcccgcgtgtttaaaagtgcgcttgtggctgctgctgtcttaactcctgtgcttggcggacagacaggcgagatggcggcggaggtgttgccgagtgcgaggtggcagtattgtggggcgcccgacgggagccagagagctgtactggtccagttctccaacgggaagctacagagtccaggcaacatgcgctttaccttgtatgagaacaaagattccaccaaccccaggaagaggaatcaacggatcctggcagctgaaacagataggctctcctatgtgggaaacaattttgggactggagccctcaaatgcaacactttgtgcaggcactttgtgggaattttgaacaagacctctggccaaatggaagtatatgatgctgaattgttcaacatgcagccactattttcaggtctttcaccaagaaagcaaaattattttctggaaagagccaaggacttgttttctaatcctgtctctgccactacctggtgaactgacctgggatgtatcagttgagagtgaactggcgctagagagtcagaccaaaacttacagagaaaagatggattcttgtattgaagcctttggtaccaccaaacagaagcgagctctgaacaccaggagaatgaacagagttggcaatgaatctttgaatcgtgcagtggctaaagctgcagagactatcattgatacgaagggtgtgactgctctggtcagcgatgctatccacaatgacttgcaagatgactccctctaccttcctccctgctatgatgatgcagccaagcctgaagacgtgtataaatttgaagatcttctttcccctgcggagtatgaagctcttcagagcccatctgaagctttcaggaacgtcacgtcagaagaaatactgaagatgattgaggagaacagccattgcacctttgtcatagaagcgttgaagtctttgccatcagatgtggagagccgagaccgccaggcccgatgcatatggtttctggataccctcatcaaatttcgagctcatagggtagttaagcggaaaagtgctctgggacctggagttccccacatcatcaacaccaaactgctgaagcactttacttgcttgacctacaacaatggcagattacggaacttaatttcggattctatgaaggcgaagattactgcatatgtgatcatacttgccttgcacatacatgacttccaaattgacctgacagtgttacagagggacttgaagctcagtgagaaaaggatgatggagatagccaaagccatgaggctgaagatctccaaaagaagggtgtctgtggccgccggcagtgaagaagatcacaagctgggcaccctgtccctcccgctgcctccagcccagacctcagaccgcctggcaaagcggaggaagattacctagacgcatgctttccagacagggcgttttggctgcatcacagccactggctggtcctattcatttccatttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggaggaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctg

SEQ ID NO: 167499 - DNA, 2083 bp, Homo sapiens
  Payload ID: 12951
  Gene Symbol: POLR2A
  Gene Name: polymerase (RNA) II (DNA directed) polypeptide A, 220kDa
  Uniprot ID: P24928
  ENST ID: ENST00000572844
  CDS Start-End: 146-1846
ccaccttcccctcctccggctttttcctcccaactcggggaggtccttcccggtggccgccctgacgaggtctgagcacctaggcggaggcggcgcaggctttttgtagtgaggtttgcgcctgcgcagcgcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagtgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcgggtgtgtggtccaaatggaaacctggcttaagtgggcagtggggctctggggtgcaaggtggaggctagagaggaagagctgtgttttttttcctgacttacccagcagtggtctgtgagattgtcttttctggtgggcgaacaaaaagggggttaggaaaactcaggccaaaaaggtgtaaggcgttaattccccatttaattccttaaaatttcatgtaataccaggtattgcctgtaaaggaaagataaagggaaaaataagtaa

SEQ ID NO: 167500 - DNA, 6751 bp, Homo sapiens
  Payload ID: 12951
  Gene Symbol: POLR2A
  Gene Name: polymerase (RNA) II (DNA directed) polypeptide A, 220kDa
  ENST ID: ENST00000617998
  CDS Start-End: 400-6342
gctcagaagcgccgagagcgcggccgggacggttggagaagaaggcggctcccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttccccgcctccttccctcccccaccttcccctcctccggctttttcctcccaactcggggaggtccttcccggtggccgccctgacgaggtctgagcacctaggcggaggcggcgcaggctttttgtagtgaggtttgcgcctgcgcagcgcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagtgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaataacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccacaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgctgtgcagttcttgcctccctcacggggcgtcacccccagcccagctccgttgtacataaatgccttgtggcagagctcccggtgaacttctggatcccgtttctgatgcagactcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaa

SEQ ID NO: 167501 - DNA, 6738 bp, Homo sapiens
  Payload ID: 12951
  Gene Symbol: POLR2A
  Gene Name: polymerase (RNA) II (DNA directed) polypeptide A, 220kDa
  ENST ID: ENST00000621442
  CDS Start-End: 387-6299
gagagcgcggccgggacggttggagaagaaggcggctcccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttccccgcctccttccctcccccaccttcccctcctccggctttttcctcccaactcggggaggtccttcccggtggccgccctgacgaggtctgagcacctaggcggaggcggcgcaggctttttgtagtgaggtttgcgcctgcgcagcgcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagtgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaataacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgctgtgcagttcttgcctccctcacggggcgtcacccccagcccagctccgttgtacataaatgccttgtggcagagctcccggtgaacttctggatcccgtttctgatgcagactcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaagt

SEQ ID NO: 167502 - DNA, 3748 bp, Homo sapiens
  Payload ID: 12952
  Gene Symbol: POLR2B
  Gene Name: polymerase (RNA) II (DNA directed) polypeptide B, 140kDa
  Uniprot ID: P30876
  ENST ID: ENST00000314595
  CDS Start-End: 44-3568
cttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagcgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtg

SEQ ID NO: 167503 - DNA, 4108 bp, Homo sapiens
  Payload ID: 12952
  Gene Symbol: POLR2B
  Gene Name: polymerase (RNA) II (DNA directed) polypeptide B, 140kDa
  Uniprot ID: P30876
  ENST ID: ENST00000381227
  CDS Start-End: 414-3938
actgagaacctacttaaagctatggcaaaggcactggaggattgagctaggtgggcagaaaagagcagtgtcgttatttgtgcaacaacattgaaaaacaagcagaaataaaacattgacggaacggatacgaccgcagattgcgggagctgtcctctcaatcagcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggtttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagcgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtc

SEQ ID NO: 167504 - DNA, 3666 bp, Homo sapiens
  Payload ID: 12952
  Gene Symbol: POLR2B
  Gene Name: polymerase (RNA) II (DNA directed) polypeptide B, 140kDa
  ENST ID: ENST00000431623
  CDS Start-End: 197-3496
gtggtattctgggaacgtcggagacggaagttacttcgtctttagctcctggcgctgctggcttctgggcggtttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagcgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtc

SEQ ID NO: 167505 - DNA, 3839 bp, Homo sapiens
  Payload ID: 12952
  Gene Symbol: POLR2B
  Gene Name: polymerase (RNA) II (DNA directed) polypeptide B, 140kDa
  ENST ID: ENST00000441246
  CDS Start-End: 317-3820
attctgggaacgtcggagacggaagttacttcgtctttagctcctggcgctgctggcttctgggcggtttttgtcttttgatttcaagagttaggagctcgagaaccgtttggcaatatgtacgacgcggatgagggctggagtgcagtggcgcgatctcagctcctgcgaggaggcggaccgcccattccgtgcccggtagccgcgagggaccggtggtagccgcgagggacgggcggcgggctcggtgctgtggcgaggcggggatggcactcccccccgccgccccgtggggcggccccgactttcgggcgatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagcgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaac

SEQ ID NO: 167506 - DNA, 539 bp, Homo sapiens
  Payload ID: 12952
  Gene Symbol: POLR2B
  Gene Name: polymerase (RNA) II (DNA directed) polypeptide B, 140kDa
  ENST ID: ENST00000433463
  CDS Start-End: 310-539
acttcgtctttagctcctggcgctgctggcttctgggcggtttttgtcttttgatttcaagagttaggagctcgagaaccgtttggcaatatgtacgacgcggatgaggagtctcgctctgtggcccaggctggagtgcagtggcgcgatctcagctcctgcgaggaggcggaccgcccattccgtgcccggtagccgcgagggaccggtggtagccgcgagggacgggcggcgggctcggtgctgtggcgaggcggggatggcactcccccccgccgccccgtggggcggccccgactttcgggcgatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccggtaagata

SEQ ID NO: 167507 - DNA, 608 bp, Homo sapiens
  Payload ID: 12952
  Gene Symbol: POLR2B
  Gene Name: polymerase (RNA) II (DNA directed) polypeptide B, 140kDa
  ENST ID: ENST00000450656
  CDS Start-End: 417-608
ctcgcgatttaagctctgagactgagaacctacttaaagctatggcaaaggcactggaggattgagctaggtgtcgttatttgtgcaacaacattgaaaaacaagcagaaataaaacattgacggaacggatacgaccgcagattgcgggagctgtcctctcaatcagcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggtttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcct

SEQ ID NO: 167508 - DNA, 2057 bp, Homo sapiens
  Payload ID: 12953
  Gene Symbol: POLR2C
  Gene Name: polymerase (RNA) II (DNA directed) polypeptide C, 33kDa
  Uniprot ID: P19387
  ENST ID: ENST00000219252
  CDS Start-End: 339-1166
atggacagtacaaacagtactaccacgaacgtccctgcactcgtatctttgtttacaactgcaagtgtttctgcagtatgaattcttagaagtgttactgttaagtgaaggacgtatgcgtgttttgccaaactaccctccgagatagctgaatctggtacattttaaagcaggaggccgcagaagacgctcggcagttctggcctccgagcagcaggcggcgctgtgagtcgtctttgcggaagccgcggaggcctcgctgactgacttccggtgttggcggtggcgccgcgcagtcaccgcggagcagacgcggaggctggtggcccctgggcgagatgccgtacgccaaccagcctaccgtgcggatcacggagctcactgacgagaatgtcaagttcatcatcgagaacaccgacctggcggtggccaattcgattcggagggtcttcatcgctgaggttcccataatagccattgactgggttcagattgatgccaattcctcagttcttcatgatgaattcattgctcacaggcttggattaattcccctcattagtgatgacattgtggacaagctgcagtactctcgggactgcacatgtgaggagttctgccccgagtgctcggtggagttcaccctcgatgtgcggtgcaatgaagaccagacgcgacatgtcacgtctcgagacctcatctccaacagcccccgggtcattccggtgacatcccggaaccgagataatgaccccaatgactacgtggagcaggatgacatcctcatcgtcaagttgagaaagggccaggagctgagacttcgagcctatgccaaaaagggctttggcaaggagcatgccaagtggaaccctactgcaggggtggcttttgaatacgatccagacaatgccctgaggcacacagtgtaccccaagcccgaggaatggccaaagagtgagtactcggagctggatgaggatgagtcgcaggctccctatgaccccaacggcaagccagaaaggttttactacaatgtggagtcctgtggctctctgcgtcctgaaaccattgtcctgtcagccctctcaggattgaagaagaaactgagtgatttacaaactcaattaagccacgagatccagagtgatgtgctaaccataaattaactgcagcttgcctgcttcagcaaaaacggagattcaggccagcagctggatatgggggtctctcttcagactcttctcgtttctgagaatctagtctactgttggttgagcttcttggcaggacatcagtaccaactagaagtgggtcatagatagattaccagggatgcagtggtgtttaggcaggataggtctttactggccctgactgctgttaataattggcagcagtgctccccagatcccagaaggtccctgctggagtgtttccagtgcacctgtagggaaccaactagacttctctcctggttagtccagctctttactctaaaccctttctgtccaaaatgagtcattttcagttgtaccttagatgtctggtgttgaggatcaagtgccatagcctttattcagggggcctataaacccttccagttcttgccccagggctggcctgctagcgcttcaaattcccaggtgtccctaatttgagaagtaaccttttggaatagcattagaccctggctgtcccctccccaccaaataaacatgatatttcattctctgtccagcagtcatgaaccccttcacctccaatgacctgatcatttagtttggtgggggtgggggtgggggtgggggtggaagcagccgcaggagcaagggcccctcccacatacacaggaggagtatttcatttctccttaatgaaggctctggccctaacccctcagcactgtctccagataggaacatgcacaaagcagttaattaggcagcctggagaaaaccagagatccagtacagaaaggaaaggatatttattgattaacagaagttgtctttttaaaagtgtttatttttggcaataaagagcacaacataatctcc

SEQ ID NO: 167509 - DNA, 748 bp, Homo sapiens
  Payload ID: 12953
  Gene Symbol: POLR2C
  Gene Name: polymerase (RNA) II (DNA directed) polypeptide C, 33kDa
  ENST ID: ENST00000562599
  CDS Start-End: 57-197
gtggcgccgcgcagtcaccgcggagcagacgcggaggctggtggcccctgggcgagatgccgtacgccaaccagcctaccgtgcggatcacggagctcactgacgagaatgtcaagttcatcatcgagaacaccgacctggcggtggccaattcgattcggagggtcttcatcgctgaggttcccataataggataatggcttccaggccgcgctcgcgcctgtaattccagcactttgggaggccaagactgaggaacacctgaggccaggagtttgagaccagcctggccaacatggggaaagcccgcctctactaaaaatgcaaaaattagccaggtgtggtggctcccacctgtaatcccagctactggggaggctgaggcagaattgattgaacccagaaggtggaggttgcagtgagccgagatcatgccactgcactctggcctgggcaatagagtgagactccttctcaaacaaaagaaaataaaaaagaagatagtggcttccagccacgtccatgttgctgcagaggacatgatttcgttcgttcttatggctgcatcacttactgcttttgtgaaacttggccattgactgggttcagattgatgccaattcctcagttcttcatgatgaattcattgctcacaggcttggattaattcccctcattagtgatgacattgtggacaagctgcagtactctcgggactgcacatgtgaggagttctgccccgagtgct

SEQ ID NO: 167510 - DNA, 5042 bp, Homo sapiens
  Payload ID: 12954
  Gene Symbol: POLR2D
  Gene Name: polymerase (RNA) II (DNA directed) polypeptide D
  Uniprot ID: O15514
  ENST ID: ENST00000272645
  CDS Start-End: 58-486
ttgctccgcgcttctgcttccggcggcgctggtggtggcgcgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaatttttttttttttttacttcataggccaggcttgaagttctgaacactttgaagtctccaattatgagagatccagtctaagcctctggcctgctaattagcaataagtgctttatttggaaggagggagtcatccactcttgagccactgcagtgaagtcacttgatctcagtctgggggaaaacacttcaatagctaaacattctagctttgatttttctgaagggaatacacttgttttcaattttggggtttttctttggggcacttgcttgactctgtatgaacttgtgatccaaggaaaaaggagaaagaacagtgttggcttttaaaatcaggatggttttatgtttgctacgaaataaggcaagaataaaaaattcttatttttatttatttatttattttttgagatagagtctggctgtgttgcccaggatgcaatggcgcaatcttggctcactgcaacctctgccttctgggttcaagtgattctcctgcctcagcctcccaagtagctgggattacaggtacctgccaccacgcctggctaattttttgtgtttttagtagagacagggtttcaccacgttcgccaggctagtcttgaactgacctcaagtgatcctcccacctcggcttcccaaagtgctgggattacaggcgtgagccaccggccaatctttttatccttgagcaacttcgcttctttgagcctcattggtgttctcaattgtgaaatatggataatagtatctgccccatgggtattttgagaaggttgaatgaacaggaaattattacaaagagcctagaggtgtctgatatatagtatgttccagtaaatgttcactattcttagcatctcaggcagatgagctagtatagatagatgattaagtcagcttgcttcatagaaattagtgcaagaatttgttagcctaccaactgatagtatcagacttggaaaataaatgaaattgggccaggcgtggtggctcacccttgtaatcccagcgctttcagaggccgaggcaggcggatcacctgaggttgggagtttgagaccatcctgaccaacatggagaaaccccgtctctacttaaaatacaaaattagcggggcgtggtggcgcatgcctgtaatctcagctactctggaggctgaggcaggagaattgcttgaacctgggaggcagagggggtggcgagccaagattgcaccattgtactccagcctaggcaacaagagcgaaactgtctcaaaaaaaaaaaaaaaaaaaaagtgaaattgcttacccaaatctacagttaactttcgttttttaatgcttgatgaatttgcatgtcattcttgggcagtggccatgctgtcttctctgtattgttccaatttgggtatatgtgctgccaaagtgagtactgcagaattatttcttgagagaggcacttacatgtgctgattggcactaaagcagtggaatgggaagaagagacttggaaggcagcccagacgatccaggcgtgtgctagatggcaactgaggagcacggtgctaccatctttactggtgtttccacctatgtgccaggggttctgtgagctacctgagaatactgaagtatataatgctctggcacatagttaggcactaatcagtggtatttatcaaggtgattaaaagcagatttaaaaagcagctcacagttgggcgcggtggctcacacctgtaatcccagcactttgggaggccgaggcgggtggatcaccagaggtcagaagttcgagaccagcctggccaacgttgtgaaaccctgtctctactaaaaatacaaaaattggccacgtgtggtggcgggcacctgtaatcctagctacttgggaagctgagacaggagaattgcttgaacccgggaggtggaggttgcagtgagccaagatcatgccattgcactccagcctgggcaacaagagcgagactccatcttgaaaaaaaataaaataataaaaagcagctcatactagggaacttggtaaagcaacctcatgctgttgtaggttgaaagcctggtcagctattctgcaagacagtcaaaaattgtttacagggctggacagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttcaccagaaagctaaattaaccagataagtctttctgaaagttttagtgtcttagtttgttcctgcgctgtaacagaataccttagactgggtaacctataaataataggaatttatttctcacagttttggaggctggcaaatgcaagatccaggtgctggtacgttcagtgtctggcaagggcggctttctggtccaagatggtgcctttttttctgcatcttccatagggaatgaacactccttatggtagaagggatggaaggaccaggctttttttttttttttttttggatacagcaggatcttgctctgtcgcccaggctggagtgcagtggcatgattaaggttcactgcagcctcaatctcccactctccagcgatcatcccacctcagcctcttggatagctgggaccacaggcacgagctaccatgcctggctaatttattttttgtagagacggggtttcgccatgttgcccaggctggtctggaatttctgacctctagcagtccacctgtttccgcctcccaaatgctgagattagaggcatgagtcactgcacccagcccgcagcctcttttataagggcattaatccccttcatgagggatattctctcatgacttaatcacctgccaaagaccccacctcttaatactacatcagtgatgggttcaatgtatcaattgggtgggagggggcacattcagaccatagcatctagtcattctggttttattaagatttattagacctgaggcatgaaaaatagcatactggatgggacttcagcatcgatgagttgccttagtaatactgttaataaaaagcactaaatatgcca

SEQ ID NO: 167511 - DNA, 806 bp, Homo sapiens
  Payload ID: 12954
  Gene Symbol: POLR2D
  Gene Name: polymerase (RNA) II (DNA directed) polypeptide D
  ENST ID: ENST00000409698
  CDS Start-End: 226-540
aaggccctgcctcagcggcggcttgggcaagccccagcgcggcgtggggctggggagggaacatggccttgggagggaccatggccttgggagggaccgcctgggcaactgggttattttatgtgataaactgcgaagttccggggacctgtgtcaaagataaacaaagccggacactcaggtgagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacat

SEQ ID NO: 167512 - DNA, 1758 bp, Homo sapiens
  Payload ID: 12954
  Gene Symbol: POLR2D
  Gene Name: polymerase (RNA) II (DNA directed) polypeptide D
  ENST ID: ENST00000409955
  CDS Start-End: 18-350
cgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaact

SEQ ID NO: 167513 - DNA, 1286 bp, Homo sapiens
  Payload ID: 12955
  Gene Symbol: POLR2E
  Gene Name: polymerase (RNA) II (DNA directed) polypeptide E, 25kDa
  ENST ID: ENST00000215587
  CDS Start-End: 60-674
gtccgcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatctggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcagcccctgctctctgtctctgcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccatgcacgcgctcaagccaccagggtgcgagatgccagctctggagttctcggttgttgtaggaggttgggtgttttcaaatggtaaagatgttttgagcaaataaatttgcttgatacagaaac

SEQ ID NO: 167514 - DNA, 1096 bp, Homo sapiens
  Payload ID: 12955
  Gene Symbol: POLR2E
  Gene Name: polymerase (RNA) II (DNA directed) polypeptide E, 25kDa
  Uniprot ID: P19388
  ENST ID: ENST00000586746
  CDS Start-End: 40-672
ggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatctggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagttccacaggcgcatgggccacgtttccagtgcttggtggccatgtggggctgacgtgcgaaaccttagagccgggggatacgtccgtcatcgagaacgttttcctggactgccctgggctgcaggtggacgtgacgaggtcattcgatgcctgaccgtctgcacagcctgtggtgaagaccacccgggctcccacctcgcggggccccgtggcggggggttcccttcctcacacatccctcccctagggggaggcccagggccacgccacggggctctctctgtcccctccctggccccttcttctaagcttgcagctgccacagaaaatcttctaagcttgcagctgccacagaaaacacccgattaaaaactttttatttcagcaaaataaacgtgcctgtgaaagaa

SEQ ID NO: 167515 - DNA, 1214 bp, Homo sapiens
  Payload ID: 12955
  Gene Symbol: POLR2E
  Gene Name: polymerase (RNA) II (DNA directed) polypeptide E, 25kDa
  ENST ID: ENST00000591767
  CDS Start-End: 22-228
gcggcggcggcggaggctgccatggacgacgaggaggagacgtaccggctctggaaaatccgcaagaccatcatgcaggtgagcagcgggtcccgggggagttccggtgaagccaccagagcacctgccgaggagccggtcgctagcacccacccccactcgcctggtgcccagcatttgtctctctgcccagtctgggaggaaaactcccctccccttccttgctaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccatgcacgcgctcaagccaccagggtgcgagatgccagctctggagttctcggttgttgtaggaggttgggtgttttcaaatggtaaagatgttttgagcaaataaatttgcttgatacagaaaccaggccgactaacaa

SEQ ID NO: 167516 - DNA, 1105 bp, Homo sapiens
  Payload ID: 12955
  Gene Symbol: POLR2E
  Gene Name: polymerase (RNA) II (DNA directed) polypeptide E, 25kDa
  ENST ID: ENST00000589737
  CDS Start-End: 61-216
agtccgcgcgggttctcgcgcggagaaggggtgcgagcggcggcggcggcggaggctgccatggacgacgaggaggagacgtaccggctctggaaaatccgcaagaccatcatgcagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccatgcacgcgctcaagccaccagggtgcgagatgccagctctggagttctcggttgttgtaggaggttgggtgttttcaaatggtaaagatgttttgagcaaataaatttgcttgatacagaaaccaggccgactaacaa

SEQ ID NO: 167517 - DNA, 2831 bp, Homo sapiens
  Payload ID: 12955
  Gene Symbol: POLR2E
  Gene Name: polymerase (RNA) II (DNA directed) polypeptide E, 25kDa
  Uniprot ID: P19388
  ENST ID: ENST00000615234
  CDS Start-End: 43-675
cgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatctggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccatgcacgcgctcaagccaccagggtgcgagatgccagctctggagttctcggttgttgtaggaggttgggtgttttcaaatggtaaagatgttttgagcaaataaatttgcttgatacagaaaccaggccgactaacaaggtttccagcaggtggccttgcctcaccccaagcacacgaggtcagcctggcaggtgtgccctcctcgcgctggcttcaggggtcagtgtctccccaggccctcgccctgccctcccacttcgtgctcctgggtaaggcgtgagcgtgtctgtctcttcccttcccgtgagggtgtggagttgttctctggcttgtgcagctgtggtttgcggccagttcctcttacagacgtttgggatctggctctacttccccgtttgcttactgtctgatttcagaaggcctcgcctgcccaagtttaacctagccacgtggttctctcacagtagctttattaagatgtaattcaccctcgggcggtcggtggtctgtaacgcgcccactgttctgtgcagcagggtccccagatccccaggccgcggactgtgtgtgtgatggggacagtgcttccccttctctccaaatgtacttttttcaaaattgtcttggccaaagcaagccagacccaaagggacaaacactgatgtcactcctaggaggtcactagagtcgtcagagactggaagtaggatgggggttcccgggactggggagttgggtggggatgggggttcccagggctggggaggagggaggggacagagtgtgtcatgtgcacagttttagtttgggaagatgagaaaattctggaggtggccgggcgcggtggctcacgcctgtaatcccagcactttgggaggccgaggtgggcggatcacctgaggtcgggagttcgagaccagcctgaccaacatggcaaaatcccatcactgcaaaaaatacaaaaattacctgggcgtggtggtgcatgcctgtaatcccagctacttgggagctaaggcaggagaatcacttgaacccaggaagtggaggatcgcttgagctcaggagttaaaagaccagcccgggcaacacagagaaaccccccacctctacaaaaaactttaagattacctgggcacagtggctcacacctgtaatcccaacactttgggaggctgaggcgggaggatcatttgagcccaggaggccgaggctgcagtgagctacgattgtgctcctgtactccagcctgggccacagggtcacaccctgtctcaaaaaaaaaaaaaaatgcagttccacaggcgcatgggccacgtttccagtgcttggtggccatgtggggctgacgtgcgaaaccttagagccgggggatacgtccgtcatcgagaacgttttcctggactgccctgggctgcaggtggacgtgacgaggtcattcgatgcctgaccgtctgcacagcctgtggtgaagaccacccgggctcccacctcgcggggccccgtggcggggggttcccttcctcacacatccctcccctagggggaggcccagggccacgccacggggctctctctgtcccctccctggccccttcttctaagcttgcagctgccacagaaaatcttctaagcttgcagctgccacagaaaacacccgattaaaaactttttatttcagcaaaataaacgtgcctgtgaaagaa

SEQ ID NO: 167518 - DNA, 1052 bp, Homo sapiens
  Payload ID: 12955
  Gene Symbol: POLR2E
  Gene Name: polymerase (RNA) II (DNA directed) polypeptide E, 25kDa
  ENST ID: ENST00000590060
  CDS Start-End: 1-252
cctgcctcagcctcccaaagtgctaggattacagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaagaaaccaggccgactaacaaggtttccagcaggtggccttgcctcaccccaagcacacgaggtcagcctggcaggtgtgccctcctcgcgctggcttcagggttccacaggcgcatgggccacgtttccagtgcttggtggccatgtggggctgacgtgcgaaaccttagagccgggggatacgtccgtcatcgagaacgttttcctggactgccctgggctgcaggtggacgtgacgaggtcattcgatgcctgaccgtctgcacagcctgtggtgaagaccacccgggctcccacctcgcggggccccgtggcggggggttcccttcctcacacatccctcccctagggggaggcccagggccacgccacggggctctctctgtcccctccctggccccttcttctaagcttgcagctgccacagaaaatcttctaagcttgcagctgccacagaaaacacccgattaaaaactttttatttcagcaaaataaa

SEQ ID NO: 167519 - DNA, 932 bp, Homo sapiens
  Payload ID: 12955
  Gene Symbol: POLR2E
  Gene Name: polymerase (RNA) II (DNA directed) polypeptide E, 25kDa
  ENST ID: ENST00000619917
  CDS Start-End: 52-606
gggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatctggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcacccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttc

SEQ ID NO: 167520 - DNA, 487 bp, Homo sapiens
  Payload ID: 12955
  Gene Symbol: POLR2E
  Gene Name: polymerase (RNA) II (DNA directed) polypeptide E, 25kDa
  ENST ID: ENST00000585838
  CDS Start-End: 1-404
cagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagaggcggacacacagcgacccccatccctgcaggacaaacgcccctgccctgccagaatccggcccccac

SEQ ID NO: 167521 - DNA, 1749 bp, Homo sapiens
  Payload ID: 12955
  Gene Symbol: POLR2E
  Gene Name: polymerase (RNA) II (DNA directed) polypeptide E, 25kDa
  Uniprot ID: P19388
  ENST ID: ENST00000612655
  CDS Start-End: 66-698
ggcgcagtccgcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatctggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccatgcacgcgctcaagccaccagggtgcgagatgccagctctggagttctcggttgttgtaggaggttgggtgttttcaaatggtaaagatgttttgagcaaataaatttgcttgatacagaaaccaggccgactaacaaggtttccagcaggtggccttgcctcaccccaagcacacgaggtcagcctggcaggtgtgccctcctcgcgctggcttcaggggtcagtgtctccccaggccctcgccctgccctcccacttcgtgctcctgggtaaggcgtgagcgtgtctgtctcttcccttcccgtgagggtgtggagttgttctctggcttgtgcagctgtggtttgcggccagttcctcttacagacgtttgggatctggctctacttccccgtttgcttactgtctgatttcagaaggcctcgcctgcccaagtttaacctagccacgtggttctctcacagtagctttattaagatgtaattcaccctcgggcggtcggtggtctgtaacgcgcccactgttctgtgcagcagggtccccagatccccaggccgcggactgtgtgtgtgatggggacagtgcttccccttctctccaaatgtacttttttcaaaattgtcttggccaaagcaagcca

SEQ ID NO: 167522 - DNA, 811 bp, Homo sapiens
  Payload ID: 12956
  Gene Symbol: POLR2F
  Gene Name: polymerase (RNA) II (DNA directed) polypeptide F
  ENST ID: ENST00000333418
  CDS Start-End: 1-436
ctggatggacagagggacgagggacgagcatctgccgtcgtgtcccggctgccctgcagtcgcctccaacacccgctgctgcccgcccgctgcctgcctgcctggcatctctctctcccgggctgggaccgtctcttctccctcctgtcttctacatgggatggactcaggagcgctcaacagatgctctgaaatcaatgactctgaatctagaagtcaaccggagaatgtgctcctcagagggccctggaatcttcccctcgtgcacttgggtttcagtttgctgaataagacggactctgctgcctgctcttcagagaaggttttggtggaggactcccctcaggtgcccctgcctggatcccccactgccccagaaggctggccttcagatgcctgggtagctggcttgcttgacccaagcatggacaagtgagaacagatgaaagaggccagcagacccaggacccagccctttctctgccaccagccagcactcactctgctgtgtgacctgagaccaggcagaccatctctctgggtctcagtttccccctctataacaccaggggctggtcttcatgatcccagggccctccccagctgtgcccatctgcaactgtgagattctgagagcagaggagggaaggcgggatggcccctctttccccaccgcctctctctgtcccccagggtcaccccaaagccgccccctcccccggctccctggaacttccctgcagctgcaggcctggtgagacaattgggtgttttagagaaatacatttttgggctaatttgccatgcataa

SEQ ID NO: 167523 - DNA, 560 bp, Homo sapiens
  Payload ID: 12956
  Gene Symbol: POLR2F
  Gene Name: polymerase (RNA) II (DNA directed) polypeptide F
  ENST ID: ENST00000405557
  CDS Start-End: 78-458
gcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaacttctctgggggctggaatacacagtgctgagaccctcctacgcactggcccacagcctaggctctttcagcatctcctcccgctgacttctcccgacagtcctgctgggtggatatcatcaccccattgtacagatgcataaactgagcccaggttgctgatggtctcacccgagctgaacacaggat

SEQ ID NO: 167524 - DNA, 582 bp, Homo sapiens
  Payload ID: 12956
  Gene Symbol: POLR2F
  Gene Name: polymerase (RNA) II (DNA directed) polypeptide F
  ENST ID: ENST00000407936
  CDS Start-End: 92-568
ataagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaacgcccgctcggcctcagaaccgcccggagaggagccgccctggatggacagagggacgagggacgagcatctgccgtcgtgtcccggctgccctgcagtcgcctccaacacccgctgctgcccgcccgctgcctgcctgcctggcatctctctctcccggaggcggcggctcagagaggagtgactcgcctgaagccc

SEQ ID NO: 167525 - DNA, 883 bp, Homo sapiens
  Payload ID: 12956
  Gene Symbol: POLR2F
  Gene Name: polymerase (RNA) II (DNA directed) polypeptide F
  ENST ID: ENST00000427034
  CDS Start-End: 1-281
ggacagagggacgagggacgagcatctgccgtcgtgtcccggctgccctgcagtcgcctccaacacccgctgctgcccgcccgctgcctgcctgcctggcatctctctctcccgggctgggaccgtctcttctccctcctgtcttctacatgggatggactcaggagcgctcaacagatgctctgaaatcaatgactctgaatctagaagtcaaccggagaatgtgctcctcagagggccctggaatcttcccctcgtgcacttgggtttcagtttgctgaataagacggactctgctgcctgctcttcagagaaggttttggtggaggactcccctcaggtgcccctgcctggatcccccactgccccagaaggctggccttcagatgcctggtaggcgggcaccaggttggggaggaggcttggttggtgccttgtccatcctcctgagcactgaagccctgaataggcagcttctgagcagaacactcaatttccctctctttccctcctgcccagggtagctggcttgcttgacccaagcatggacaagtgagaacagatgaaagaggccagcagacccaggacccagccctttctctgccaccagccagcactcactctgctgtgtgacctgagaccaggcagaccatctctctgggtctcagtttccccctctataacaccaggggctggtcttcatgatcccagggccctccccagctgtgcccatctgcaactgtgagattctgagagcagaggagggaaggcgggatggcccctctttccccaccgcctctctctgtcccccagggtcaccccaaagccgccccctcccccggctccctggaacttccctgcagctgcaggcctggtgagacaa

SEQ ID NO: 167526 - DNA, 2106 bp, Homo sapiens
  Payload ID: 12956
  Gene Symbol: POLR2F
  Gene Name: polymerase (RNA) II (DNA directed) polypeptide F
  Uniprot ID: P61218
  ENST ID: ENST00000442738
  CDS Start-End: 126-509
agtgatttcctctgggttacggcgcaggcgcaagataagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttccaacccccttcccctctgcttatctgcaatgtcaccacctgttgcttccccgttaccgccatgctgcgtggagcatgcacctattccagtggccctgtgactgtcagctccttaagaagcaccaggggcccttagcccctttggatcccccacatccttccctccatctccctgttccccagagcaaaggctgctgcaggggagacacctcagctgccttccaagcagacagacaagtctttgtgcccagggagctggttgccacggaaacccccaatttcctttccagtggggactggctgcaggggcttctcccttctcaggagtatcacagagcaggtctcatcaagccacccattgtttcctaaggacctgcttcgagcctcttatcgtgggctcggatcccctttcaggagcagtgccccagcaggaagcgtgggggtgtgctgatctcccaccctccccaggcagagccctgctgggcaagtcagcagctggagcaaggaccgagcacctgcctacccctgcccccatggctctgtccccactcctcctcaggactctgcccacacgctgtcctctgtggcccacctctttggtgtgccacacccatgccttcttcctagcctctataagatatcctttccctcctatttggggctggtgatcccctgaggccttggggacatggtgctggggtggtggtgctcctgggttccaggtgttacattaagtcagagctggagttcccccttcctctgcctgaggttctaatgggtcctcttcctttctccaccctgcttacccaacctgaggtaagaccagtcacactggctcctccctcctagagggggtcagggggagggtgtatattgacatgaacagggatagagggtaaactggctccctgaatatgccagccttaacctccattccactgccagctccccttcaaagaggaggagctgggcttccctaacctctgcaggaggcagggcctccaggcctaggtgcagcctggccctgggatgggatgtggggagtgaatggtgaggatctgcattggtgggaggggtgtccgctgccctggagaagggttaattcagggagcagtggacttcacactcccatccaccctcctccaagcctgtggaatcctttaatcaagttgggtgctgaaatttcagctctgaaatgccgcctttgtgctggcatccaggcagccgccccagagtgcgggggtcactttctcggccccatttctctaaatggtctctttgttccctgctgggctgctcagtatcagatgtgattaaagggagatggggtttgggctggggaggaggggaattgggggttaacccttaggggatagagtgcaagggaaatgggacagaaggggtgtttttcctcctgtcttcctcttcccattctcctcttttggggagtcccctgctattcagctgtctgggcctggcttttgacttctcttgaataaaatgtcccggtcacca

SEQ ID NO: 167527 - DNA, 1890 bp, Homo sapiens
  Payload ID: 12956
  Gene Symbol: POLR2F
  Gene Name: polymerase (RNA) II (DNA directed) polypeptide F
  ENST ID: ENST00000443002
  CDS Start-End: 90-425
aagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaactacttccagaaagcatttgaggaagcaccagtacagggataagagatgaagagacaggccaggtcaggctcaccaagcaggcagccctttctgccccatcctgcacagtaagagagacttctcagggatccctctgagaagtgcagagccccagcttgacccctggtcccttctctgcagacacccagcacacgcgcgttctggtctggttcaaggtggaaacacaagactaaagctgccaggaggccaaggtgaacggcaatcatgtgattaacacacacacacataaaaagctttttaacagcgcccgctcggcctcagaaccgcccggagaggagccgccctggatggacagagggacgagggacgagcatctgccgtcgtgtcccggctgccctgcagtcgcctccaacacccgctgctgcccgcccgctgcctgcctgcctggcatctctctctcccggtcccggatttactcagaagatgggccccagagaggaggagaggaaaggaatacctgtcagtcaaacgtgaagcccactgatgacactgcctggcagagctgcctccggtcagcagtgacccttcaccccccagctcccaagtcctcttcctgagggagctggtccggctttatggaaggctccgcctgtgttcccccactgggtccctggtccctcacctgtcacgtggggcgatggtcaccctccctccctgcctgccctgaaggatacactgagatgaaggtcaggaaatctgctggctgcagaaccaggggccatgcaggagtgagggatggtctggtcaagttgaggctctgccccagcctcagtttccccacacaggcatgagactgtcttcctgactttcagaggacagggctgagatgggatgagggaacacagggaaagcgtttagcacctctgagtgctgtgtggatgcgacctggggggtcctggcctccactctttaattctatctggactgtgtgccctcctacctccagtttccctgcgggggcctttcacagggcctggcttgcggatacggggtttggcgtagggcagtgcttctcaaatgggaaggcgcactgggattcttcaggttggggtggggcctgaggttctgcatttctaatcagttgcctaggactggctctaattcttgttgaatttacaatcacttgtggagttaagaaaaacatactgggccttggttgggtgtggtggctcacacctgtaatcccagcactttgggaggccaaggtgggcagatcatgaggtcgagagattgagaccatcctggccaacatggtgaaaccttgtctctactaaaaaaaaaaaaaaaaaaaaattagctgggcatggtggcaggcgcctgtaatcccagctacttgggaggctgaggcaggagaatcacttgaacccgggaggtggaggttgcagtgagctgagattgcaccattgcactccagcctgggcaaaaagagcgaaactctgtctcaaaa

SEQ ID NO: 167528 - DNA, 518 bp, Homo sapiens
  Payload ID: 12956
  Gene Symbol: POLR2F
  Gene Name: polymerase (RNA) II (DNA directed) polypeptide F
  ENST ID: ENST00000460648
  CDS Start-End: 92-316
ataagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggtcagtattcagcctcaggctcccacctctgcagcccaagctgccaaatcgtctgacaggatgtgtgcccctgtgatggtggagctggagggggagacagatcctctgctcattgccatgaaggaactcaagtaagtcactcaaatcatggttcacttctccaaatctctgggaggcatctgttgggctctctgttgcaccctttgctcccacttgcctggctggagaagttgatgcttattcctacagatccttaggaacagctcaccaggaagtaggaggaagagagaagaggaggcagggaaagtgggagggcactgatgagacatggacgtct

SEQ ID NO: 167529 - DNA, 564 bp, Homo sapiens
  Payload ID: 12956
  Gene Symbol: POLR2F
  Gene Name: polymerase (RNA) II (DNA directed) polypeptide F
  ENST ID: ENST00000488684
  CDS Start-End: 90-320
aagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggtcagtattcagcctcaggctcccacctctgcagcccaagctgccaaatcgtctgacaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaagtaagtcactcaaatcatggttcacttctccaaatctctgggaggcatctgttgggctctctgttgcaccctttgctcccacttgcctggctggagaagttgatgcttattcctacagatcct

SEQ ID NO: 167530 - DNA, 550 bp, Homo sapiens
  Payload ID: 12956
  Gene Symbol: POLR2F
  Gene Name: polymerase (RNA) II (DNA directed) polypeptide F
  ENST ID: ENST00000492213
  CDS Start-End: 215-550
aagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagagttttagtagtgacggggttcaccgtgttagccaggatggtctcgatctcctgccttgtgatccgcccgcctcggcctcccaaagtgctgggattacaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggac

SEQ ID NO: 167531 - DNA, 584 bp, Homo sapiens
  Payload ID: 12956
  Gene Symbol: POLR2F
  Gene Name: polymerase (RNA) II (DNA directed) polypeptide F
  ENST ID: ENST00000470701
  CDS Start-End: 130-498
cgctgtttgcgggtctccgcgcgggaccggggcgcagcggggtcgctgaggcgagggtgtcatgtcagacaacgaggacaagtgagtgcgggagcggagtggcctttgcggcaaccttggaaggggcggatgagttttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttccaa

SEQ ID NO: 167532 - DNA, 615 bp, Homo sapiens
  Payload ID: 12956
  Gene Symbol: POLR2F
  Gene Name: polymerase (RNA) II (DNA directed) polypeptide F
  ENST ID: ENST00000483713
  CDS Start-End: 90-320
aagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggtcagtattcagcctcaggctcccacctctgcagcccaagctgccaaatcgtctgacaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttc

SEQ ID NO: 167533 - DNA, 760 bp, Homo sapiens
  Payload ID: 12956
  Gene Symbol: POLR2F
  Gene Name: polymerase (RNA) II (DNA directed) polypeptide F
  ENST ID: ENST00000606538
  CDS Start-End: 78-374
gcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaagtaagtcactcaaatcatggttcacttctccaaatctctgggaggcatctgttgggctctctgttgcaccctttgctcccacttgcctggctggagaagttgatgcttattcctacagatccttaggaacagctcaccaggaagtaggaggaagagagaagaggaggcagggaaagtgggagggcactgatgagacatggacgtcttctggctgttggaatttccctgttcctgctgcaggaggccttaccaatattctgtcattcttccccctcttgtctgatataaaaactttctttttcttgtaattgctttcttacaaagtacactcatcagccccaagaggctgctcctaagacttctctttgcttgtgttttgcacacaatctg

SEQ ID NO: 167534 - DNA, 827 bp, Homo sapiens
  Payload ID: 12957
  Gene Symbol: POLR2G
  Gene Name: polymerase (RNA) II (DNA directed) polypeptide G
  Uniprot ID: P62487
  ENST ID: ENST00000301788
  CDS Start-End: 106-624
agtcgcagcaagcgcggaactggggttgcggcgtctaagtgtttccggtggattcccagggactgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaagtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctca

SEQ ID NO: 167535 - DNA, 1053 bp, Homo sapiens
  Payload ID: 12957
  Gene Symbol: POLR2G
  Gene Name: polymerase (RNA) II (DNA directed) polypeptide G
  ENST ID: ENST00000524819
  CDS Start-End: 67-192
tgtttccggtggattcccagggactgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaagtgagtgtcgagctcaccgcaccgccagatcgttcgatgcgcacacggggcgctatacctgcaacccctccccaactcctactcgtcctgccacccactctggggacccctctcctctctcaggcagccagttgcttcctgctttgggttcccagggcgccctctgcaatgctggacaataagacttccttctctcagctgagatgggtcattcattgactcctcaaacattttaaaaacccttggtgtgtgccaggacccgtgttgggctcagaacaaggtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaa

SEQ ID NO: 167536 - DNA, 388 bp, Homo sapiens
  Payload ID: 12957
  Gene Symbol: POLR2G
  Gene Name: polymerase (RNA) II (DNA directed) polypeptide G
  ENST ID: ENST00000533442
  CDS Start-End: 348-388
ggggttgcggcgtctaagtgtttccggtggattcccagggactgtcggagatctccctagagcacgaaatcctgctgcacccgcgctacttcggccccaacttgctcaacacggtgaagcagaagctcttcaccgaggtggaggggacctgcacagggaagtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagat

SEQ ID NO: 167537 - DNA, 919 bp, Homo sapiens
  Payload ID: 12957
  Gene Symbol: POLR2G
  Gene Name: polymerase (RNA) II (DNA directed) polypeptide G
  ENST ID: ENST00000525455
  CDS Start-End: 70-264
aagtgtttccggtggattcccagggactgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaaaatcaagactgtctggggcagacctgagaatctgcattttaagaagatgattctcaggcatcccgaagattgagatctgttgcctcaaggactccagccttcttggacatttattgtgaaattaccagaacagcatttggtcttacacatactgatctctgttctgtcttcttttggtcattaagctctctgggagcagaggtgctatctacttgtccttttgctctccccgaccctacccccaagagctcagcgacttttattgcagatgtctttagaggctcttggacacacagtgtcttcctgtttctcatcctccttgcaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttc

SEQ ID NO: 167538 - DNA, 1556 bp, Homo sapiens
  Payload ID: 12957
  Gene Symbol: POLR2G
  Gene Name: polymerase (RNA) II (DNA directed) polypeptide G
  ENST ID: ENST00000531944
  CDS Start-End: 33-158
gtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaagtgagtgtcgagctcaccgcaccgccagatcgttcgatgcgcacacggggcgctatacctgcaacccctccccaactcctactcgtcctgccacccactctggggacccctctcctctctcaggcagccagttgcttcctgctttgggttcccagggcgccctctgcaatgctggacaataagacttccttctctcagctgagatgggtcattcattgactcctcaaacattttaaaaacccttggtgtgtgccaggacccgtgttgggctcagaacaaggtagaatgggaacaagatagaatgaggacagcccctgtggagctcacagtgtaatcattgttcctgtgtctgctctccctctgtcattctgctggttttctcttatcccctgtgcccagggaccacacaccatgggcctctatatatcttctgaatgaatgaccagaaaaagcagatcgagagtttgggggaggaaggaagtagcctgggatttgaccatctctgggctttgcacagaggggcctctctgatattaatgagctgggacccagctcagggcagtggagtacttgggcctccagcatcagaaaaacctgcaggaacatgcagattcctgagcctccttattccctacagaatcaagactgtctggggcagacctgagaatctgcattttaagaagatgattctcaggcatcccgaagattgagatctgttgcctcaaggactccagccttcttggacatttattgtgaaattaccagaacagcatttggtcttacacatactgatctctgttctgtcttcttttggtcattaagctctctgggagcagaggtgctatctacttgtccttttgctctccccgaccctacccccaagagctcagcgacttttattgcagatgtctttagaggctcttggacacacagtgtcttcctgtttctcatcctccttgcaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctca

SEQ ID NO: 167539 - DNA, 660 bp, Homo sapiens
  Payload ID: 12957
  Gene Symbol: POLR2G
  Gene Name: polymerase (RNA) II (DNA directed) polypeptide G
  ENST ID: ENST00000531996
  CDS Start-End: 1-183
atctccctagagcacgaaatcctgctgcacccgcgctacttcggccccaacttgctcaacacggtgaagcagaagctcttcaccgaggtggaggggacctgcacagggaaaatcaagactgtctggggcagacctgagaatctgcattttaagaagatgattctcaggcatcccgaagattgagatctgttgcctcaaggactccagccttcttggacatttattgtgaaattaccagaacagcatttggtcttacacatactgatctctgttctgtcttcttttggtcattaagctctctgggagcagaggtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatt

SEQ ID NO: 167540 - DNA, 1802 bp, Homo sapiens
  Payload ID: 12958
  Gene Symbol: POLR2H
  Gene Name: polymerase (RNA) II (DNA directed) polypeptide H
  Uniprot ID: P52434
  ENST ID: ENST00000456318
  CDS Start-End: 1050-1502
gggacggcccagccaggctggggtccgcgcggggcctcccgagaggcggcaaggggcgctgggaaggcgcaagcccgcgccggctccctgcggatgcccgggtcggagaggggcgcccgggaggggcgggtctactggcacgtggaggggccggcccgggttcgcggttccccgtgcccaggcaggaggggctgcagacgcctgagctccgtaggggttggggctgggggctgcggagctgtctacatcggactcctccgggtcagcccgttaggagccgcctcccctctgcccctccgaagagacgagcggcccagacaggcctgggaaggcccctctgccccgtcaggggtgaaaagcaaagctggaaggattcggagagggttggggccgtcttcctcatccttccttttctcggggctcccgtggcgacgtcatggcaaattcccaaactggacggatccggctcgggttacgtccagcagggccgagccggcccaggccggccccggggtcctcggtgccggctggaggggctgggcacctctggggcggggttctgctccacctgccctcggcgcggactgtgccctcggcgggcacgcggaccggcggggtagggctagggcccggcttctctgggccaaggatcaaggtccctgcctgggttaggcccccacgcattccagtcttcggaacccggcctctgaagagggcgcagtagggccccagcggagcgcgagaacccgctctacagcctattgcttccccgccctgggcagagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccagtt

SEQ ID NO: 167541 - DNA, 807 bp, Homo sapiens
  Payload ID: 12958
  Gene Symbol: POLR2H
  Gene Name: polymerase (RNA) II (DNA directed) polypeptide H
  Uniprot ID: P52434
  ENST ID: ENST00000443489
  CDS Start-End: 250-510
actctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgaggtaagtaagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttcca

SEQ ID NO: 167542 - DNA, 994 bp, Homo sapiens
  Payload ID: 12958
  Gene Symbol: POLR2H
  Gene Name: polymerase (RNA) II (DNA directed) polypeptide H
  Uniprot ID: P52434
  ENST ID: ENST00000438240
  CDS Start-End: 394-738
agcccgcgccggctccctgcggatgcccgggtcggagaggggcgcccgggaggggcgggtctactggcacgtggaggggccggcccgggttcgcggttccccgtgcccaggcaggaggggctgcagacgcctgagctccgtaggggttggggctgggggctgcggagctgtctacatcggactcctccgggtcagcccgttaggagccgcctcccctctgcccctccgaagagacgagcggcccagacaggcctgggaaggcccctctgccccgtcaggggtgaaaagcaaagctggaaggattcggagagggttggggccgtcttcctcatccttccttttctcggggctcccgtggtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccc

SEQ ID NO: 167543 - DNA, 791 bp, Homo sapiens
  Payload ID: 12958
  Gene Symbol: POLR2H
  Gene Name: polymerase (RNA) II (DNA directed) polypeptide H
  Uniprot ID: P52434
  ENST ID: ENST00000452961
  CDS Start-End: 208-552
ctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgaggtaagtaagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttt

SEQ ID NO: 167544 - DNA, 836 bp, Homo sapiens
  Payload ID: 12958
  Gene Symbol: POLR2H
  Gene Name: polymerase (RNA) II (DNA directed) polypeptide H
  ENST ID: ENST00000412877
  CDS Start-End: 802-836
ggcccagccaggctggggtccgcgcggggcctcccgagaggcggcaaggggcgctgggaaggcgcaagcccgcgccggctccctgcggatgcccgggtcggagaggggcgcccgggaggggcgggtctactggcacgtggaggggccggcccgggttcgcggttccccgtgcccaggcaggaggggctgcagacgcctgagctccgtaggggttggggctgggggctgcggagctgtctacatcggactcctccgggtcagcccgttaggagccgcctcccctctgcccctccgaagagacgagcggcccagacaggcctgggaaggcccctctgccccgtcaggggtgaaaagcaaagctggaaggattcggagagggttggggccgtcttcctcatccttccttttctcggggctcccgtgggcccccacgcattccagtcttcggaacccggcctctgaagagggcgcagtagggccccagcggagcgcgagaacccgctctacagcctattgcttccccgccctgggcagagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgt

SEQ ID NO: 167545 - DNA, 823 bp, Homo sapiens
  Payload ID: 12958
  Gene Symbol: POLR2H
  Gene Name: polymerase (RNA) II (DNA directed) polypeptide H
  ENST ID: ENST00000455712
  CDS Start-End: 378-823
gaagagctggtatccaagggacagggcagtgccaggctgaaggggcacggaggggatccgtgtccaggagaaggcagtggagggggaacgcgcagcactaagctggagggagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagc

SEQ ID NO: 167546 - DNA, 1159 bp, Homo sapiens
  Payload ID: 12958
  Gene Symbol: POLR2H
  Gene Name: polymerase (RNA) II (DNA directed) polypeptide H
  Uniprot ID: P52434
  ENST ID: ENST00000430783
  CDS Start-End: 492-860
tctgctccacctgccctcggcgcggactgtgccctcggcgggcacgcggaccggcggggtagggctagggcccggcttctctgggccaaggatcaaggtccctgcctgggttaggcccccacgcattccagtcttcggaacccggcctctgaagagggcgcagtagggccccagcggagcgcgagaacccgctctacagcctattgcttccccgccctgggcagagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccagt

SEQ ID NO: 167547 - DNA, 878 bp, Homo sapiens
  Payload ID: 12958
  Gene Symbol: POLR2H
  Gene Name: polymerase (RNA) II (DNA directed) polypeptide H
  Uniprot ID: P52434
  ENST ID: ENST00000429568
  CDS Start-End: 60-587
cgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctgctgagattgagagctgctgagtggcagtgctccagaatcacgggatggggccttctgtttcagctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccagtttg

SEQ ID NO: 167548 - DNA, 913 bp, Homo sapiens
  Payload ID: 12959
  Gene Symbol: POLR2I
  Gene Name: polymerase (RNA) II (DNA directed) polypeptide I, 14.5kDa
  Uniprot ID: P36954
  ENST ID: ENST00000221859
  CDS Start-End: 491-868
aatccagaggggccttccatagttcacggttcttccaatagcggcccgggaaaggaccagaacaggcggcgaagactgaagcccggaggtaggagtggcaagagctcgcccagtccgcgaagggtaaactcgcgcatgcgcactggccttcaaccaagccaagcgccttggcttctgtcctggatgctcagtgttttgcggtttacgatgcgcatcgttttcccggctctggcaccagatccatactattctgtaaactgaggcggcgatgcccaaaaattggaagcaattactctaagatatcaaaagattgaagcaagccatgaaacctctgcgcggagagagccgagcccgaggcggcggggagccagcacgtgtgcgcagctccgccctcttttggcgaagcacctaggcctggcccctcccgcgacctgtagcgcggcggagcaagcgcggaaggctgggagggctgcgcgggctgcgcgtcgccatggagcccgacgggacttacgagccgggcttcgtgggtattcgcttctgccaggaatgtaacaacatgctgtaccccaaggaagacaaggagaaccgcattctgctctacgcgtgccggaactgtgattaccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcacagccccacactgcggccaccgctggaccgagtgacctcctctctcccccgagtgtaataaacaccagattccatgcgtg

SEQ ID NO: 167549 - DNA, 368 bp, Homo sapiens
  Payload ID: 12959
  Gene Symbol: POLR2I
  Gene Name: polymerase (RNA) II (DNA directed) polypeptide I, 14.5kDa
  ENST ID: ENST00000585842
  CDS Start-End: 5-145
cgccatggagcccgacgggacttacgagccgggcttcgtgggtattcgcttctgccaggaatgtgccggaactgtgattaccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcacagccccacactgcggccaccgctggaccgagtgacctcctctctcccccgagtgtaataaacaccagattccatg

SEQ ID NO: 167550 - DNA, 493 bp, Homo sapiens
  Payload ID: 12959
  Gene Symbol: POLR2I
  Gene Name: polymerase (RNA) II (DNA directed) polypeptide I, 14.5kDa
  ENST ID: ENST00000592962
  CDS Start-End: 51-317
ggcggagcaagcgcggaaggctgggagggctgcgcgggctgcgcgtcgccatggagcccgacgggacttacgagccgggcttcgtgggtattcgcttctgccaggaatgtaacaacatgctgtaccccaaggaagacaaggagaaccgcattctgctctacgcgtgccggaactgtgattaccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgagcgttcagctggtactggggaggtgcggccacaaggaggctgtgttcttccagtcacacagtgcgcgggccgaggacgccatgcgcctttactacgtgtgcacagccccacactgcggccaccgctggaccgagtgacctcctctctcccccgagtgtaataaacaccagattcca

SEQ ID NO: 167551 - DNA, 744 bp, Homo sapiens
  Payload ID: 12959
  Gene Symbol: POLR2I
  Gene Name: polymerase (RNA) II (DNA directed) polypeptide I, 14.5kDa
  ENST ID: ENST00000586439
  CDS Start-End: 358-531
gcatgcgcactggccttcaaccaagccaagcgccttggcttctgtcctggatgctcagtgttttgcggtttacgatgcgcatcgttttcccggctctggcaccagatccatactattctgtaaactgaggcggcgatgcccaaaaattggaagcaattactctaagatatcaaaagattgaagcaagccatgaaacctctgcgcggagagagccgagcccgaggcggcggggagccagcacgtgtgcgcagctccgccctcttttggcgaagcacctaggcctggcccctcccgcgacctgtagcgcggcggagcaagcgcggaaggctgggagggctgcgcgggctgcgcgtcgccatggagcccgacgggacttacgagccgggcttcgtggtaacaacatgctgtaccccaaggaagacaaggagaaccgcattctgctctacgcgtgccggaactgtgattaccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcacagccccacactgcggccaccgctggaccgagtgacctcctctctcccccgagtgtaataaacacc

SEQ ID NO: 167552 - DNA, 932 bp, Homo sapiens
  Payload ID: 12960
  Gene Symbol: POLR2J
  Gene Name: polymerase (RNA) II (DNA directed) polypeptide J, 13.3kDa
  Uniprot ID: P52435
  ENST ID: ENST00000292614
  CDS Start-End: 48-401
gcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgtcctgtacatagattaggttttatattcctaataaagtatagcgggagagacctggatgtggacttgagcagcggtgacttcgcaagcaaatggattgtcaggcttgatgcaggcagatgacctgtttcaggggcgtccggctggcagggatgaattcattctggaccaaagatccggggtccaggggctgctgcgggggctgtgctgagccggagagaagtgtgcaaacccatgagctcccaagagtctctgctctagaagcctcaactcctgggcctgcctgtcagtcaaagcaggaacacttcttcctgcataactcgaaacacctttccacaggcttcttgtccacagtagagtttaataaaaatattcactgaaagacccccccc

SEQ ID NO: 167553 - DNA, 784 bp, Homo sapiens
  Payload ID: 12960
  Gene Symbol: POLR2J
  Gene Name: polymerase (RNA) II (DNA directed) polypeptide J, 13.3kDa
  ENST ID: ENST00000393794
  CDS Start-End: 47-523
cggcggcggcggacccttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtgagggcggggcctggaggggcagacggggtgggctggacactggcccgtgtgcccaggcctgggacagccctggcctgtttcttcggaggtcctgggggagaggcggcagtgatggaagagcagggacttccaccacaggctccaggacatgtggactgaggggctgtggagtctgggcctgtggctcccgtctgccccatgggacttctgtagtgctgcagggtccctcgggtgctgtgggccagatcggggcggggacctactgtcctttgggggtgctcttctacgtcccttgttggtgattggcaaggcctggtccttccaggtctctgggaggcagctcacccccgggtggcccacacctgttcctggcagggcgcatgggaatctagaacagtttagaggggaaagagccacagc

SEQ ID NO: 167554 - DNA, 348 bp, Homo sapiens
  Payload ID: 12961
  Gene Symbol: POLR2J2
  Gene Name: polymerase (RNA) II (DNA directed) polypeptide J2
  Uniprot ID: Q9GZM3
  ENST ID: ENST00000333432
  CDS Start-End: 1-348
atgaacgcccctccagccttcgagtcgttcttgctcttcgagggcgagaagatcaccattaacaaggacaccaaggtacccaaggcctgcttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtga

SEQ ID NO: 167555 - DNA, 2065 bp, Homo sapiens
  Payload ID: 12961
  Gene Symbol: POLR2J2
  Gene Name: polymerase (RNA) II (DNA directed) polypeptide J2
  ENST ID: ENST00000358438
  CDS Start-End: 29-505
ggggtctggacgcaacggcggcgggagcatgaacgcccctccagccttcgagtcgttcttgctcttcgagggcgagaagatcaccattaacaaggacaccaaggtacccaaggcctgcttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctcagggagaggcggcggtgatggaagaacagggacttccaccacaggctccaggacatgtggactgaggggctgtggagtctgggcctgtggctcccgtctgccccatgggacttctgtagtgctgcagggtccctcgggtgctgtgggccagatccgggcggggacctactgtcctttgggggtgctcttctacgtcccttgtcggtgattggcaaggcctggtccttccaggcctctgggaggcagctcaccccagggtggcccacacctgttcctagcagggcgcctgggaatctagaacagtttagaggggaaagagccacagcaaagaaaagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctaggtaacagagcaggactccatctcagtcaatcaatcaatcaatcaatctcagcggttgaactacccttgacatggttcagctctgtatccacacccaaatctcatgtcaaattgtaattcccagtgttgtgggagggacctggtgggaggtgattggctcatgggggccgacttcccccttgctgttctcgtgatattgagtgagcgcttgtgggatctggttgtttaaaagcgtgcagccctcccacttcactctctctgtctctcctgctccaacatggccagacgtgcctgcttccccttcgccttctgccgtgattgtcagtttcctgaggcctccccagccacgcttcctgtacagcctgcagaactgtgagtcaattaaacctcttttcttcataaattacccagtttctcatagttctttatagcagtgtgaaaacagactaatggacccttctggttgaaggaatgcagccattctgcttgtttgactatgtcctttctattcatctctatttcctgggaggtgtttatccaagtgcaataggaggtattggtgaccgcacagtcccctcagtgttctgctagtaaatagttgaaggttgatcattgatcttctgcgttttcagtctggcatggaaaagcccctgtgcaactggtaaagatatcaataagcaccaggaggtatctaaatccaccaggagccataggcatcacgttgacgtccatttaccagtcttccctggcaagattcttctgaattgtgctgccttggccaaaagaggtatgggaggggctgggcgcagtggcttgtgcctgtaatcccaacattttgggaaaccaattcaggtggatcgttagaggtcaggggttcaagaccatcctggccgacatggtgacatcccatctctactaaaaatacaataagttagctgggtttggtgttgggtgcctgtaatcccagctactcgagaggctgaggcaggataatcgcttgaacctgggaggaggaggtggcagtgagctgagatcgtgccattgcactccagcgtgggcaacaagagtgaaacgtcgtctc

SEQ ID NO: 167556 - DNA, 1598 bp, Homo sapiens
  Payload ID: 12962
  Gene Symbol: POLR2J3
  Gene Name: polymerase (RNA) II (DNA directed) polypeptide J3
  Uniprot ID: Q9H1A7
  ENST ID: ENST00000379340
  CDS Start-End: 19-366
cgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccgtctcttgaccttgtgatccgcccgactcggcctcccaaaatgctgggattacaggcgtgagccatcaagtctggtgagagagattgtttctagatgagggtgggggcgggtgtccttagcccaaagcttgtgccagtctctatcagaaataaatgcccccaaaacctc

SEQ ID NO: 167557 - DNA, 2456 bp, Homo sapiens
  Payload ID: 12962
  Gene Symbol: POLR2J3
  Gene Name: polymerase (RNA) II (DNA directed) polypeptide J3
  ENST ID: ENST00000464525
  CDS Start-End: 40-426
ggcggacacttggggtctggacgcaacggcggcgggagcatgaacgcccctccagccttcgagtcgttcttgctcttcgagggcgagaaacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctcagggagaggcggcggtgatggaagaacagggacttccaccacaggctccaggacatgtggactgaggggctgtggagtctgggcctgtggctcccgtctgccccatgggacttctgtagtgctgcagggtccctcgggtgctgtgggccagatccgggcggggacctactgtcctttgggggtgctcttctacgtcccttgtcggtgattggcaaggcctggtccttccaggcctctgggaggcagctcaccccagggtggcccacacctgttcctagcagggcgcctgggaatctagaacagtttagaggggaaagagccacagcaaagaaaagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctaggtaacagagcaggactccatctcagtcaatcaatcaatcaatcaatctcagcggttgaactacccttgacatggttcagctctgtatccacacccaaatgtcatgtcaaattgtaattcccagtgttgtgggagggacctggtgggaggtgattggctcatgggggccgacttcccccttgctgttctcgtgatattgagtgagcgcttgtgggatctggttgtttaaaagcgtgcagccctcccacttcactctctctgtctctcctgctccaacatggccagacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccgtctcttgaccttgtgatccgcccgactcggcctcccaaaatgctgggattacaggcgtgagccatcaagtctggtgagagagattgtttctagatgagggtgggggcgggtgtccttagcccaaagcttgtgccagtctctatcagaaataaatgcccccaaaacctcc

SEQ ID NO: 167558 - DNA, 2553 bp, Homo sapiens
  Payload ID: 12962
  Gene Symbol: POLR2J3
  Gene Name: polymerase (RNA) II (DNA directed) polypeptide J3
  ENST ID: ENST00000489144
  CDS Start-End: 47-523
cggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctcagggagaggcggcggtgatggaagaacagggacttccaccacaggctccaggacatgtggactgaggggctgtggagtctgggcctgtggctcccgtctgccccatgggacttctgtagtgctgcagggtccctcgggtgctgtgggccagatccgggcggggacctactgtcctttgggggtgctcttctacgtcccttgtcggtgattggcaaggcctggtccttccaggcctctgggaggcagctcaccccagggtggcccacacctgttcctagcagggcgcctgggaatctagaacagtttagaggggaaagagccacagcaaagaaaagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctaggtaacagagcaggactccatctcagtcaatcaatcaatcaatcaatctcagcggttgaactacccttgacatggttcagctctgtatccacacccaaatgtcatgtcaaattgtaattcccagtgttgtgggagggacctggtgggaggtgattggctcatgggggccgacttcccccttgctgttctcgtgatattgagtgagcgcttgtgggatctggttgtttaaaagcgtgcagccctcccacttcactctctctgtctctcctgctccaacatggccagacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccgtctcttgaccttgtgatccgcccgactcggcctcccaaaatgctgggattacaggcgtgagccatcaagtctggtgagagagattgtttctagatgagggtgggggcgggtgtccttagcccaaagcttgtgccagtctctatcagaaataaatgcccccaaaacctcc

SEQ ID NO: 167559 - DNA, 1532 bp, Homo sapiens
  Payload ID: 12962
  Gene Symbol: POLR2J3
  Gene Name: polymerase (RNA) II (DNA directed) polypeptide J3
  ENST ID: ENST00000486319
  CDS Start-End: 129-479
acagggggcgatgagccgatccttgcgcgggtttgccccgccggagtaatccggaagaggcctcttattagggctctggtggcggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccgtctcttgaccttgtgatccgcccgactcggcctcccaaaatgctgggattacaggcgtgagccatcaagtctggtgagagagattgtttctagatgagggtgggggcgggtgtccttagcccaaagcttgtgccagtctctatcagaaataaatgcccccaaaacct

SEQ ID NO: 167560 - DNA, 958 bp, Homo sapiens
  Payload ID: 12962
  Gene Symbol: POLR2J3
  Gene Name: polymerase (RNA) II (DNA directed) polypeptide J3
  ENST ID: ENST00000513506
  CDS Start-End: 136-958
cagcccaacagggggcgatgagccgatccttgcgcgggtttgccccgccggagtaatccggaagaggcctcttattagggctctggtggcggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcc

SEQ ID NO: 167561 - DNA, 546 bp, Homo sapiens
  Payload ID: 12962
  Gene Symbol: POLR2J3
  Gene Name: polymerase (RNA) II (DNA directed) polypeptide J3
  ENST ID: ENST00000513438
  CDS Start-End: 63-284
attagggctctggtggcggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcgctggagtgcaatggcacgatcttgctcactgcaacctccgcctcccgggttcaagtgattctcctgcttcagccttcctagtagctgggactacaggcccacgccacgatgcccggctaatttttgtgtttttagtagagacggggattcactgtgttggccaggctggtctcgaactcctgacctcaggtgatccacctgctggcttcccaaagtgctgggattagagacgtgagctactgcgcccggccttacattcaccattaagtgcacattctgtaaatgaacgagcagcagattccagcacagtaggcctgtttgttattcatgctgagggacattg

SEQ ID NO: 167562 - DNA, 4630 bp, Homo sapiens
  Payload ID: 12962
  Gene Symbol: POLR2J3
  Gene Name: polymerase (RNA) II (DNA directed) polypeptide J3
  ENST ID: ENST00000511313
  CDS Start-End: 63-293
attagggctctggtggcggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactgtgagtcaattaaacctcttttcttcataaattacccagtttctcatagttctttatagcagtgtgaaaacagactaatggacccttctggttgaaggaatgcagccattctgcttgtttgactatgtcctttctattcatctctatttcctgggaggtgtttatccaagtgcaataggaggtattggtgaccgcacagtcccctcagtgttctgctagtaaatagttgaaggttgatcattgatcttctgcgttttcagtctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagaggtatgggaggggctgggcgcagtggcttgtgcctgtaatcccaacattttgggaaaccaattcaggtggatcgttagaggtcaggggttcaagaccatcctggccaacatggtgacatcccatctctactaaaaatacaataagttagctgggtttggtgttgggtgcctgtaatcccagctactcgagaggctgaggcaggataatcgcttgaacctgggaggaggaggtggcagtgagctgagatcgtgccattgcactccagcgtgggcaacaagagtgaaacgtcgtctcaaaaaataaaaaaaaggtccgggcttgatggctcacacctgtaatcccagcactttgggaggccaagacgggtggatcacgaggtcaggagttcaagaccagcctggcctagatggtgaaaccctgtctctactaaaactacaaatattagctgggcatggtggcatgcacctgtaatctcagctactcagaagtctgatgcaggagaattgctaaaacccaggagggagaggttgcagtgagccgagattgcaccactgcactctagcctgggcgacagagcaagactccgtctcgaaagaaagaaagaaagaaaggaaattccccagggaagtacctcggctgatttcataaacaggtaccgaaggaagcagaggcatgtggaggacttccccacctcatgcagctatttgggccatggcgtctgaaatttattatttcagagtcacccctttgatgaccttggcagtgaactgcagtcatctgtttaggcctttccatggcccacgtcaatgccgttatttctgtttgttgcacatttgatttccttgttgttggcatttagaaggccccctgcttcccagatcacaccacgggcatggaccacagagattgcatcttgtgagtctgtagaaatggtcaaggccttgtcctctcttaggtccagagctcaggtgaatgcagattttcccggccatctgtgctgaagtccctgtggggaggctcctggctggtttcctgtaggtagacagctacacgtcctgcccttcattggcttcttttcatgaagctcctgccatctacaaaacatgtctcccttcttgaatcacatctctgttattgaaactctagaagtcaaccgggcatggtggctatgcctataatcccagcattttgggatgccaaggcgggtggatcacctgaggtcaggagttcaagaccagcctgaccaacatggcgaaaccccgtctctaatacaaatacaaaaattagccaagcatggtggtcactgtactccagcctgggtgacagagcaagactccgtctcaaaaaaaaaaaagagaaagaaagtatcatgcttttctgcattctgtgaattgttttagtgagttatcgaacttgagggcatggtgggaacctccaaatttgcagccagttggtgagaagtacatgtggtctgaggacacccaagcctgcaggtgtgtctaaagcgagggcagcctagtggggactggtggccttaacctgtggcatttgaggtaacatcagggagttgacatcagaattgcatcacataggctgggcgcggtggctcacgcctgtaatcctagcactttgggaggccaaggcgggcagatcacgaggtcaggagatcgagaccatcctggctaagacagtgaaatcccgtctctactaaaaattcaaaaaattagccaggcatggtggcgggcgcctgtagtcccagctactcgggaggctgaggcaggagaatggcgtgaacccaggaggcagagcttgcattgagccaagatcacgccaccgcactccagcctgggtgacagagcgagactccatcccccccaaaaagaaaaaagacaaaaaaaaaattgtgtcacacaggccagatgcagtggctcatgcttataatcccagcaatttgaaaggcaaggtaagaggatcgcttgagcttgagtctgaggccgcagtgagctatgaccacaccactgcaccccagtctgggtgacagcgcaagaccccaactccaaaaaggaaaaagaaaaatcacaaggaattgcatgtcagagtgcctgtctttcacagctttaactgctgcaggaacgaactttttttttttttttttttttgagagggggtgaggagacacaatctctgctagtgattctcctgcctcagcctcccaaatagctgggattataggcgtgcaccaccacgcctgcctaatttttgtatttttagtagagacagggtttcaccatgttggccaggctggtctcaaactcctgctgggatcatgggcgtgagccaccacgcccggccacctttagagttttcttaccacctggttttcctctctcaatatctttctctcatttcctgccttaaaactctagcttggcatctgggcgcagtagctcatgcctgtaatcccagcactttgggaggccgaggtaggtggatcacttgaagtcaggagttcgagaccagcctggccaacatggtgaaaccttgtctctactatttttacaaaagttagtcggacgtacagacgggtgcctgtagtcccagctacttgggaggctgaggcaggagaatttgtttgaacccagaggtgaaagttgcagggagccgaggttgtgccactgcactccagcctgggagacagagcaagactctgtctccaaaacaaacaaacaaacaaaaaaaccctgtagcttgggatcagccttctcttctattgtttttctttaaaaaataaaaattaaaaatagatgtagatgctatgttgctgaggctggcctcaaactcctggcctcaggtgatcctcccgccatgacctccaaaaccacagggattgtaggtgtgagcactgcacccagccttatgtttttttctacataaaaaacagcacaggattatcttccagagctaataaatatgttcaaataaccacaaccccattaaggaaaaatatcactgggcagcaaataatcaatccagaccaatatgatcacaattgctgtgaaggtgagaaaagttcatttttattatgtttccccaagagacgcactctattgttctcttgaaaacacacagctcatgtcctcctttagaacacacatcctctttaaagtaacatacaaacatgccaaaacaaggtaaaaaattacatctgaattctcacatttcaaatatatatgaaatatcaaataaaaatttatttttacaagaatttaggggaactactacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatataacagttataatatccatcacacagctttatagaaacagcatctattcaaaaataccagtatttccaaaatatttaaaataatatttaaagtaataataatatttaaataaataaatatatttaataaatatttaaataaataaaataatatttaaataattctatacccatgtttttcaaaataaaccaataaaatagatagtatatattagacgtgttagtatatatatctgaggcatgttaaaaatcacaactgaattctcacaattcagtcacaaacctaaacagcaaataaaaatttctatcaccagaattatgtttttttctggtggggaactaccaatagctataaatagaagagattattatggaagtatcatagataaaaagagtgctcgcttcaggagcacatgtaataatacagaaacaaatttaaagataataaaatatttaggataaaaagaattgtctcttaaaaa

SEQ ID NO: 167563 - DNA, 1030 bp, Homo sapiens
  Payload ID: 12962
  Gene Symbol: POLR2J3
  Gene Name: polymerase (RNA) II (DNA directed) polypeptide J3
  ENST ID: ENST00000508848
  CDS Start-End: 33-380
acttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcc

SEQ ID NO: 167564 - DNA, 532 bp, Homo sapiens
  Payload ID: 12962
  Gene Symbol: POLR2J3
  Gene Name: polymerase (RNA) II (DNA directed) polypeptide J3
  ENST ID: ENST00000507355
  CDS Start-End: 63-293
attagggctctggtggcggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactatgatccgcccaccttggccacccaaagtgctgggattacaggtgtgaaccactgcgcccggccagaagtttttcttgtgagttgaggtgaacatctgaatcccctcggggaactgagactacagacaggggagcctctggggctgcagacactgcagacggacggacagacagatggacaacagctggaggcttggcccggccatagggctctctgcgggacagtcccagctgctagtgtcg

SEQ ID NO: 167565 - DNA, 544 bp, Homo sapiens
  Payload ID: 12962
  Gene Symbol: POLR2J3
  Gene Name: polymerase (RNA) II (DNA directed) polypeptide J3
  ENST ID: ENST00000608621
  CDS Start-End: 63-410
attagggctctggtggcggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgcttcctgtacagcctgcagaactgaggacaacgtgatcactgtattcagctccatcaagaatggtccaggttcttctagatgatctgcacaaatggttcctct

SEQ ID NO: 167566 - DNA, 2096 bp, Homo sapiens
  Payload ID: 12962
  Gene Symbol: POLR2J3
  Gene Name: polymerase (RNA) II (DNA directed) polypeptide J3
  ENST ID: ENST00000613744
  CDS Start-End: 60-536
agggctctggtggcggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctcagggagaggcggcggtgatggaagaacagggacttccaccacaggctccaggacatgtggactgaggggctgtggagtctgggcctgtggctcccgtctgccccatgggacttctgtagtgctgcagggtccctcgggtgctgtgggccagatccgggcggggacctactgtcctttgggggtgctcttctacgtcccttgtcggtgattggcaaggcctggtccttccaggcctctgggaggcagctcaccccagggtggcccacacctgttcctagcagggcgcctgggaatctagaacagtttagaggggaaagagccacagcaaagaaaagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctaggtaacagagcaggactccatctcagtcaatcaatcaatcaatcaatctcagcggttgaactacccttgacatggttcagctctgtatccacacccaaatgtcatgtcaaattgtaattcccagtgttgtgggagggacctggtgggaggtgattggctcatgggggccgacttcccccttgctgttctcgtgatattgagtgagcgcttgtgggatctggttgtttaaaagcgtgcagccctcccacttcactctctctgtctctcctgctccaacatggccagacgtgcctgcttccccttcgccttctgccgtgattgtcagtttcctgaggcctccccagccacgcttcctgtacagcctgcagaactgtgagtcaattaaacctcttttcttcataaattacccagtttctcatagttctttatagcagtgtgaaaacagactaatggacccttctggttgaaggaatgcagccattctgcttgtttgactatgtcctttctattcatctctatttcctgggaggtgtttatccaagtgcaataggaggtattggtgaccgcacagtcccctcagtgttctgctagtaaatagttgaaggttgatcattgatcttctgcgttttcagtctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagaggtatgggaggggctgggcgcagtggcttgtgcctgtaatcccaacattttgggaaaccaattcaggtggatcgttagaggtcaggggttcaagaccatcctggccaacatggtgacatcccatctctactaaaaatacaataagttagctgggtttggtgttgggtgcctgtaatcccagctactcgagaggctgaggcaggataatcgcttgaacctgggaggaggaggtggcagtgagctgagatcgtgccattgcactccagcgtgggcaacaagagtgaaacgtcgtctc

SEQ ID NO: 167567 - DNA, 348 bp, Homo sapiens
  Payload ID: 12962
  Gene Symbol: POLR2J3
  Gene Name: polymerase (RNA) II (DNA directed) polypeptide J3
  ENST ID: ENST00000621093
  CDS Start-End: 1-348
atgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtga

SEQ ID NO: 167568 - DNA, 998 bp, Homo sapiens
  Payload ID: 12963
  Gene Symbol: POLR2K
  Gene Name: polymerase (RNA) II (DNA directed) polypeptide K, 7.0kDa
  Uniprot ID: P53803
  ENST ID: ENST00000353107
  CDS Start-End: 136-312
ggagtaagagagagagaaagagagacagcactgtgcgtcatgtaccagcgccggaagttggtctcgacacctggactagccgggttgtatttggaaacgcggagtgagtttttccgtgctgtgtaggggctaacaatggacacccagaaggacgttcaacctccaaagcagcaaccaatgatatatatctgtggagagtgtcacacagaaaatgaaataaaatctagggatccaatcagatgcagagaatgtggatacagaataatgtacaagaaaaggactaaaagattggtcgtttttgatgctcgatgaatgctgggaattcagaggaatgtcttcacttatacttggatttgctctcttcccatttctgattgttgtatagctttcgattttgcttacagtagttcccccttatcttcgggagatacattccaaggcccccagtgaactcctgaaacctcaaacagtaccaaacctttatacactgttttttccatatatatatacctatgataaagtataatgtataaattaagcatagcaagagattaataataatgtaatagaacaatgataacatactataataaaagttatgtgaatgtggttggtctctcttgctttcaaaatatcttcttgtacagtactcacctattttagaatgtggttgactacaggtaaccaaaaccacagaaagggaaactttggatgaggggggcactactgtacttaggaatacaactatatacatatgattttatttttaagaccatattatatttgggtatctactaatattttgtataaagcaattttttgttccattacgtgactttttgttttattgtatatgtaatttaacacacaataaagggtaaagttgcttccccaaaccacacttttaatcaaaacctagaatcatctgcagtccttgttaaaaatgcaggtttctagaaccctctgaagttctgattaaataaatttattgcaaacca

SEQ ID NO: 167569 - DNA, 543 bp, Homo sapiens
  Payload ID: 12963
  Gene Symbol: POLR2K
  Gene Name: polymerase (RNA) II (DNA directed) polypeptide K, 7.0kDa
  ENST ID: ENST00000522439
  CDS Start-End: 97-300
atgtaccagcgccggaagttggtctcgacacctggactagccgggttgtatttggaaacgcggagtgagtttttccgtgctgtgtaggggctaacaatggacacccagaaggacgttcaacctccaaagcagcaaccaatgatatatatctgtggagagtgtcacacagaaaatgaaataaaatctagggatccaatcagatgcagagaatgtggatacagaataatgtacaagaaaaggactaaaagatgtatccttttaacgatgctttctaaatatgagttaggaggaaatgaataatgctggggttgataaagattaatttctggttaaaatgataactttctggattacagtacttaaaaaacaaacatgattagcattttcatggaccaatgcataggctctaaataatctaaataatgctagttgattttggttctcataaatttattttttagggattctgtgcagtcaagcttgaggatagggatacattctgagaattgtgtccttaagcaatttcatcattcctacagaaac

SEQ ID NO: 167570 - DNA, 892 bp, Homo sapiens
  Payload ID: 12964
  Gene Symbol: POLR2L
  Gene Name: polymerase (RNA) II (DNA directed) polypeptide L, 7.6kDa
  Uniprot ID: P62875
  ENST ID: ENST00000322028
  CDS Start-End: 38-241
ccgggccgggccgggcagtctgggacgcgccgccgccatgatcatccctgtacgctgcttcacttgtggcaagatcgtcggcaacaagtgggaggcttacctggggctgctgcaggccgagtacaccgagggggatgcgctggatgccctgggcctgaagcgctactgctgccgccggatgctgctggcccacgtggacctgatcgagaagctgctcaattatgcacccctggagaagtgaccacgctggaacccacccacccgctgtgctgaccatgggccctgagcgtcctgccccgaattcacgaggctgaggcatccgggagctggcgtaatgcctggccgcagtgtgtgtgtatccgataccccactctggaaggaaccatccagtaaaggtctttcagaaccactaaggtcccagccctcactaggatgtcaggagccaggtctaggcccagctttcacactgtggcagcccagtgaagcagactgggccatgaactctcctagccctggggccagcctgttccacaggcacccctgcaggaggcgctgccaggagagccttccatctcggggctctttgaggttccctccttctgggtgttcttcaggctgagcagagaggctcctgtaccctctctctcggaatctgaagagccagatttaggccgggcaaaggggctcacccctataatcccaggactttgggaggccaaggcaggaggatcacttgagtccagaaattcaagacccgcctgggcatcataatgagaccccatctctacaacaaaatttaataaattagctgggcacagtgttcacacctgtagtcccggccactcggggctgaggcaggaggatcactggaacctgggaggttgccactgca

SEQ ID NO: 167571 - DNA, 585 bp, Homo sapiens
  Payload ID: 12964
  Gene Symbol: POLR2L
  Gene Name: polymerase (RNA) II (DNA directed) polypeptide L, 7.6kDa
  Uniprot ID: P62875
  ENST ID: ENST00000534030
  CDS Start-End: 22-225
agtctgggacgcgccgccgccatgatcatccctgtacgctgcttcacttgtggcaagatcgtcggcaacaagtgggaggcttacctggggctgctgcaggccgagtacaccgagggggatgcgctggatgccctgggcctgaagcgctactgctgccgccggatgctgctggcccacgtggacctgatcgagaagctgctcaattatgcacccctggagaagtgaccacgctggaacccacccacccgctgtgctgaccatgggccctgagcgtcctgccccgaattcacgaggctgaggcatccgggagctggcgtaatgcctggccgcagtgtatgttggaggcatggtctcgctgcccacaaagagccaccaccgtcttgcagcagctgtctgggaccacacggccaccggcctcctgtgagcggatccactcactgtctcgccagtcctgtgagttgttgctgccacagcagtggaactgcatcaagaacaaggctggggttgagacctggggccagaggctcctgcagaggtccagggaggccctggggatgcacgcgccctcccagcaccacccaccca

SEQ ID NO: 167572 - DNA, 4199 bp, Homo sapiens
  Payload ID: 12965
  Gene Symbol: POLR2M
  Gene Name: polymerase (RNA) II (DNA directed) polypeptide M
  Uniprot ID: P0CAP2
  ENST ID: ENST00000299638
  CDS Start-End: 215-1321
aacgctcctgcggacgcccccttctcccagtccgtgtttgtttccggaatttcaataaagctcgattcggctcgaagaagaccccgttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgaaaaattcatttgcaaattgcccgacaaaggtaaaaagatctttgactcttttgccaaactgaaagctgccattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattgtgtattggtctgatattttagtatatagtagaacatactttttttttctttaagccaaatgaaaagaggtaactttgcttttttcctttttcttacctatcaaatagcatttattacatgtctttcagtgaaatacttagttgttccaggcacctaaaatcaattaggaagacatagttcccttcttttttgggtaatgaagggagcagtctaaagaattgtatgcatgtttgcatggggttattgagacattggatgtgaaatacctaggaagacatgtatggagaatgcttaacaaatgctcttctcctttttctgtcttcccttaggaagaacgttatctctcttctgattaggaaggacttcccttttgagtagatgctggaaagtggaggttttttttgttggtttgtttgtttggttttgtgtttttttttgagatggggtcttgctctgtcgcccaggctggagtgcagtggcaggatctcggctcactgcaatctaggtggaggtctttttaaataacctcatgttacttcaggcaaatctggtacaggagaagcccaagctaactgagctgggtgaaggcttgtgcatcacctggcttgagttccttgctgtcacagatgataggttcatgtacacaacattaatgtttgataaggaaagcattttttttttgttaaaattgaattgtcagtactttacttttttccccccaaataggtatatatagactgcagaagcttcagtcccatatataaacgttcatgtcattttagaggattatatggttgtctccagagaaattaacttacattatcaaaaaattctttgtctaatatattggagtctttaaaagtgttgaagaataaaatattaattagaacaacttcaaatgctaaggtgatgttttaccgggacttaattaaatacaactttttcctttcgaaaaagactgttcacatttgcttccaggtgtaattattgctttcattccttacccccctcaagcaaatgtgaaaagtatactgacctaagattctcattagttttagttcttaaaacgaatagtaaatgatttcacagcgtaaaatttgatgttatttctggaagctggatgatatggaagagttcatgtgcctggacacacagttccctgtaatcctgccatctagggagataaactctgttaacattttgatgttgtgtttttgcttatttttctatgcatagttatgcatttatattctcaaaaatgaaatcataatgtacattgctttgtagtctgctctatatattgtcaatatgttcccatattaaatattttgctttttagacagctgtaggatattttatttcatgggtataccataactttaagatttatttcctattcagcaatttgattatgtattataatgtaatctgtaaatagtgatatgattaacatcttaatcacatccatagaaaatgacttatttccagaagataccgctctaaaaatgaaattgttaggtgaaagtgtttttgagaatttttatatatattactcactgcagagatcatgttcatttacattcccattagcaatatatccaatgctcagaattgaaaattactacttaaaatctttgcaaattgaataattacagaaaagggctacatttaaaatttgtatttgtttttcttacttagtgaaggttgtgttttttttcatattcattggccatgctatattcattcttttgagaattgctcattcatattttttctgttgcttgcttggagaatttgctctttttttggcatataagttcttaagaatgtccgtcctttgtcatatattgtaactttttttagccttatttgtcatttaacatagtttgtggtatttcagtatagaagttgttttctttaggagtctacctttgtgtatgtgcttgaaagtatttttgtaatccaagaatggataaatgtccttattttcttctagtattttcttatttcacttttacacctatctttaaaaggaatttaaattttgtttatatacattaactaaatcagtacaagtttggggtgaaaaggaaatttttaatccatctcaaatgtatttggttatattatataaggtagggatttgattttatttcgaagaatttaccaattggttcagtatgtgaaaccaccatttcccctctgattagtaatgctatttttatagaatattaaattcttatgtgtcttttgtgtcttaggccaatttctgggccttctgggttttttctacactgtcaataattatcgctttaattggtgttaatatttggtagtacacaggttctcccttgttcttttaaattttgtgaaatataacttacaaataagtacttaaaacagagcttaatgggtaaagcaacagctgtgtaatcacaaactagatgcagaggaggtcttgccagcactccaaaatctctgtgtgtcccctcttgacactcactgtttcccccagagctaactatcctgacgtatggtaattctccctctgtccttttaagaattattttaccagttatgtgtataacaatatggtttacattttgctcacttttgacttatataaaaatagaataatactata

SEQ ID NO: 167573 - DNA, 3629 bp, Homo sapiens
  Payload ID: 12965
  Gene Symbol: POLR2M
  Gene Name: polymerase (RNA) II (DNA directed) polypeptide M
  Uniprot ID: P0CAP2
  ENST ID: ENST00000380557
  CDS Start-End: 119-754
aaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgagttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattgtgtattggtctgatattttagtatatagtagaacatactttttttttctttaagccaaatgaaaagaggtaactttgcttttttcctttttcttacctatcaaatagcatttattacatgtctttcagtgaaatacttagttgttccaggcacctaaaatcaattaggaagacatagttcccttcttttttgggtaatgaagggagcagtctaaagaattgtatgcatgtttgcatggggttattgagacattggatgtgaaatacctaggaagacatgtatggagaatgcttaacaaatgctcttctcctttttctgtcttcccttaggaagaacgttatctctcttctgattaggaaggacttcccttttgagtagatgctggaaagtggaggttttttttgttggtttgtttgtttggttttgtgtttttttttgagatggggtcttgctctgtcgcccaggctggagtgcagtggcaggatctcggctcactgcaatctaggtggaggtctttttaaataacctcatgttacttcaggcaaatctggtacaggagaagcccaagctaactgagctgggtgaaggcttgtgcatcacctggcttgagttccttgctgtcacagatgataggttcatgtacacaacattaatgtttgataaggaaagcattttttttttgttaaaattgaattgtcagtactttacttttttccccccaaataggtatatatagactgcagaagcttcagtcccatatataaacgttcatgtcattttagaggattatatggttgtctccagagaaattaacttacattatcaaaaaattctttgtctaatatattggagtctttaaaagtgttgaagaataaaatattaattagaacaacttcaaatgctaaggtgatgttttaccgggacttaattaaatacaactttttcctttcgaaaaagactgttcacatttgcttccaggtgtaattattgctttcattccttacccccctcaagcaaatgtgaaaagtatactgacctaagattctcattagttttagttcttaaaacgaatagtaaatgatttcacagcgtaaaatttgatgttatttctggaagctggatgatatggaagagttcatgtgcctggacacacagttccctgtaatcctgccatctagggagataaactctgttaacattttgatgttgtgtttttgcttatttttctatgcatagttatgcatttatattctcaaaaatgaaatcataatgtacattgctttgtagtctgctctatatattgtcaatatgttcccatattaaatattttgctttttagacagctgtaggatattttatttcatgggtataccataactttaagatttatttcctattcagcaatttgattatgtattataatgtaatctgtaaatagtgatatgattaacatcttaatcacatccatagaaaatgacttatttccagaagataccgctctaaaaatgaaattgttaggtgaaagtgtttttgagaatttttatatatattactcactgcagagatcatgttcatttacattcccattagcaatatatccaatgctcagaattgaaaattactacttaaaatctttgcaaattgaataattacagaaaagggctacatttaaaatttgtatttgtttttcttacttagtgaaggttgtgttttttttcatattcattggccatgctatattcattcttttgagaattgctcattcatattttttctgttgcttgcttggagaatttgctctttttttggcatataagttcttaagaatgtccgtcctttgtcatatattgtaactttttttagccttatttgtcatttaacatagtttgtggtatttcagtatagaagttgttttctttaggagtctacctttgtgtatgtgcttgaaagtatttttgtaatccaagaatggataaatgtccttattttcttctagtattttcttatttcacttttacacctatctttaaaaggaatttaaattttgtttatatacattaactaaatcagtacaagtttggggtgaaaaggaaatttttaatccatctcaaatgtatttggttatattatataaggtagggatttgattttatttcgaagaatttaccaattggttcagtatgtgaaaccaccatttcccctctgattagtaatgctatttttatagaatattaaattcttatgtgtcttttgtgtcttaggccaatttctgggccttctgggttttttctacactgtcaataattatcgctttaattggtgttaatatttggtagtacacaggttctcccttgttcttttaaattttgtgaaatataacttacaaataagtacttaaaacagagcttaatgggtaaagcaacagctgtgtaatcacaaactagatgcagaggaggtcttgccagcactccaaaatctctgtgtgtcccctcttgacactcactgtttcccccagagctaactatcctgacgtatggtaattctccctctgtccttttaagaattattttaccagttatgtgtataacaatatggtttacattttgctcacttttgacttatataaaaatagaataatact

SEQ ID NO: 167574 - DNA, 2896 bp, Homo sapiens
  Payload ID: 12965
  Gene Symbol: POLR2M
  Gene Name: polymerase (RNA) II (DNA directed) polypeptide M
  Uniprot ID: P0CAP2
  ENST ID: ENST00000482852
  CDS Start-End: 132-1223
ccgttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgaaaaattcatttgcaaattgcccgacaaaggtaaaaagatctttgactcttttgccaaactgaaagctgccattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggaaagaccgttttacagccctcagtaccgcagttccatgaacttgctcagcttggcagccgcagctaaggacacccgtggtagtaaaagcgggaagatgggctccctggctcttcttaccaaactctgattgtttggagcagtttgaccatcatttagccaggaagacaccagaaggatggcgtgctgagagtgctagaagggagactgctgtccccacaatggctgcagccccattcctttttccaagctgcctgggtgaacattccaggatcctgacattctgtggaaattgatgagtgcttgctcaaaggtcgatgatgtgctacagatggcatcacctgttagagacagagctttctcaagaggagctttgatttcctttacttcccgaactgctatttcacagtctctcagtagatgtcagcagcacagcaaacatctcactgcccatcatggaagcaggaaaccgaggctccagagagctgggtatctttccaaggccttgacactgggaggtgatgagtcacggttggctctaaagcccaagctcttttcttcacaccttgatgccgtctagcctgtccatggaccaattagagccagtgaccaacaggtatatcaaaatgacatccctcctggatggcacatcctccccagacagcctgcccattccctggctctgacaggctagcaaatccctgataacctcggaatgcctcaagttgtgtcaatgaagggcattgagactttgatgttggacagatgccccatgatggatgggcactggctgatacagtttcccacggtgactcagaagtgcgaaggagaaaggagggctgaggtgccagctccaggcaggccaggcaccccagatgtcagcacctgcccgactgcctctgacataccctcagacataccttttggcatgtggagccccaggtgcctttcttcatgtccagataggaagactcatcttaaggggtgtggcagcaactgagcatgtgtaccaccacctgagctgtagttcttgtttctgtaagagaaaatgctcccacattatcctactacactctagacctcaaaggtgaggcagagcgtgagtcaagggatctgaaatgaaagcagttgtagtgaaaagcccatgaaatatagcgctcaagggtagctgagtcttgcaggctgtaatttatgctgtttcctgctttgagaatgtatcccaaccttttggttactagaaagcctcaatttgaatagtaaaagacctgaattctgggtcctctaacttctcttcatgtgtggctcagtctaacctgtagtttaagactcagacaccatgccttccaggaagccttccttgatgtctccaattctacattaattcctccagtatgagcttccacagtaacttaatcttaccctgaggtgtctatatcaaactgcttcctcacttgagggaaggcaccaggtcttgtttacatttttgctctatatcactacaacacaagagagaatgtgataaaggttgtaacagacccagaaaaaccactctaggagctctgagaagggtagttcatgtaaatacacacacatatacatatagttcatgtaaatatatgtatgtatacacacacacacacacacacacacagccttcatcaaggaagagattgctcttaggatgttttcagattcaagatgctgtaaaatttgtattgatgattgcttttctttctatcccttgtaatttctacacttacagctcattgttcttctcatagcattaaagtcttcagcatctgg

SEQ ID NO: 167575 - DNA, 1648 bp, Homo sapiens
  Payload ID: 12965
  Gene Symbol: POLR2M
  Gene Name: polymerase (RNA) II (DNA directed) polypeptide M
  ENST ID: ENST00000494490
  CDS Start-End: 149-265
tcggctcgaagaagaccccgttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgagtaagctggggtcccgcggagtctccgccaggctccttcagctcgagctccctgggcgctcccctcccctcccgcactctgttcccttccctggaaggtgactttgactcagtcacattcgcttcagtcctacgggcgagtggacggagggcttgctgcggcagagccgtgcctcttcctggccaggcacaaaattcatttgcaaattgcccgacaaaggtaaaaagatctttgactcttttgccaaactgaaagctgccattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaa

SEQ ID NO: 167576 - DNA, 910 bp, Homo sapiens
  Payload ID: 12965
  Gene Symbol: POLR2M
  Gene Name: polymerase (RNA) II (DNA directed) polypeptide M
  ENST ID: ENST00000464277
  CDS Start-End: 141-257
aagaagaccccgttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgagtaagctggggtcccgcggagtctccgccaggctccttcagctcgagctccctgggcgctcccctcccctcccgcactctgttcccttccctggaaggtgactttgactcagtcacattcgcttcagtcctacgggcgagtggacggagggcttgctgcggcagagccgtgcctcttcctggccagaaaattcatttgcaaattgcccgacaaaggtaaaaagatctttgactcttttgccaaactgaaagctgccattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacag

SEQ ID NO: 167577 - DNA, 6640 bp, Homo sapiens
  Payload ID: 12966
  Gene Symbol: POLR3A
  Gene Name: polymerase (RNA) III (DNA directed) polypeptide A, 155kDa
  Uniprot ID: O14802
  ENST ID: ENST00000372371
  CDS Start-End: 139-4311
gggacactctacggtggccgagaggatgccgcagatgtgttagcggcgagtccagaagcagccccaggaggtgctgggggcatcgtttctctaatctggcctcccgagtgccaaggaggcgtcccggcagcggtcatcatggtgaaggagcagttccgggagacggatgtggccaagaaaataagccacatctgttttggaatgaagtcacctgaggagatgcgccagcaggcgcacatccaagttgtgagtaagaacctgtacagccaggacaaccaacatgcccccttgctatatggggtgctcgaccataggatgggtacgagtgagaaggatcgtccatgtgaaacctgtgggaaaaacttggctgactgtctaggccactatgggtatatcgacctggagttgccgtgttttcatgtagggtacttcagagcagtcataggcatcttacagatgatctgcaaaacctgctgccacatcatgctgtcccaagaggagaagaagcagtttctggactatctaaagaggcccggcctgacctaccttcagaagcgaggactgaaaaagaaaatctctgacaagtgccggaagaaaaacatctgccatcactgtggcgcttttaatggtaccgtaaagaagtgtggactgctgaaaataattcatgagaaatacaagaccaacaaaaaagtggtggatcccattgtatcaaatttccttcagtcttttgaaacagccattgaacataataaagaagtggagcctctgctgggaagggcacaggaaaacttgaatcccttagtagttctgaatttatttaaacgaatcccagctgaagatgttcctctacttctgatgaacccagaagccggaaagccgtctgatttgattctcacacgacttttggtgcctcctttgtgtatcagaccctccgttgtgagtgatttgaagtctggcaccaatgaagatgatctgacaatgaaactgacagaaatcattttcctaaacgatgttattaaaaagcatcggatctcaggagccaagacccagatgatcatggaggactgggatttcctgcagctgcagtgtgccctctacattaacagtgagctctcgggcattcccctcaacatggcacccaagaagtggaccagaggcttcgtccaacgcctgaagggaaaacagggtcgatttagaggaaatctctcaggaaagagagtggatttttctggcagaacagtcatctcgcccgaccccaacctccggattgatgaggtagctgtgccagttcatgtggccaaaattctaacttttcctgagaaggtaaacaaagcaaacatcaatttcttgaggaaactggttcaaaacggccctgaggttcacccaggagcaaacttcattcagcagagacatacgcagatgaaaaggtttttgaaatacggaaatcgagaaaagatggctcaagagctcaagtatggtgacatcgtagagagacacctcatcgatggagatgtggtgctgttcaatcggcagccctcgctgcacaaattgagcattatggctcatctggccagggtcaagccccaccggaccttcagatttaatgagtgtgtctgtacaccctataatgctgactttgatggtgatgaaatgaaccttcatcttcctcaaacagaagaagctaaagcagaggcccttgttctgatggggactaaagcaaatcttgtaaccccgaggaatggggaaccgctgattgctgctattcaggattttctaacaggtgcctatctcctcactctcaaggacactttctttgatcgagccaaggcttgccaaatcattgcttcaatactggttggcaaggatgagaaaattaaagttcgcctcccaccgcctacaatcctaaagcctgtcaccctgtggacgggaaagcagatcttcagtgtcatcctcaggcctagcgatgacaatccagtgagggccaacctgcgaaccaagggcaagcagtactgtggcaaaggggaagatctctgtgccaatgattcctatgttacaatccagaacagtgagttgatgagtggcagcatggacaaaggaaccctagggtcaggatccaagaacaatattttttacattttgctgcgagactggggacagaatgaagctgcagatgccatgtcacggctcgccaggctggctcctgtctacctgtctaaccgtggtttctcaattgggatcggtgatgtcacacctggccaaggactgctgaaggccaagtatgagttgctgaatgccggctacaagaaatgtgatgagtacatcgaagccctgaacacgggcaagctgcagcagcagcctggctgcactgctgaggagaccctggaggcactgatcctgaaggagctgtctgtgatccgtgaccacgctggcagtgcctgcctccgggagctggacaagagcaacagccccctcaccatggctctgtgcggctccaaaggttccttcattaacatatcacagatgattgcctgtgtgggacagcaggccatcagtggctctcgagtgccagacggctttgaaaacaggtccttgcctcattttgaaaaacactcaaagctcccagctgccaaaggctttgtggctaatagcttttattccggtttgacaccaactgagtttttcttccacacaatggccggccgggaaggtctagtcgacacggctgtaaagacagctgaaacgggatacatgcagcgaaggcttgtcaaatctcttgaagatctttgctcccagtatgatctgacagtccgaagctctactggcgatattatccagttcatttatggaggagatggcttagatcctgcagctatggagggaaaagatgaacctttggagtttaaaagggttctggacaacatcaaagcagtcttcccgtgtcccagtgagcctgctctcagcaaaaacgagctgatcctgaccacagagtccatcatgaagaagagtgagttcctctgctgccaggacagcttcctgcaggaaataaaaaaattcattaagggggtctctgagaagatcaagaaaaccagagataaatatggcatcaatgataacggcacaacagagccccgtgtgctgtaccagctggaccgcatcacccccacccaagtagaaaagtttctggagacctgtagggacaagtacatgagggcacagatggagccaggttctgcagtgggtgctctgtgtgcccagagcattggtgagccaggcacccagatgaccctgaagactttccactttgcaggtgtggcctccatgaacatcaccctgggcgtgccccggattaaagagatcatcaacgcttccaaggccatcagcactccaattatcacagcacagctagacaaggatgacgacgcggattatgctcgcctcgtgaaagggagaattgagaaaaccctcttgggagagatttccgagtatattgaagaagtgtttcttcctgatgactgctttattctcgtcaagctctccctggaacggattaggcttctgagactggaagtgaacgctgagacagtgagatattccatctgcacatccaagctccgtgtgaagcccggtgatgtggctgttcatggtgaggctgtggtgtgtgtcacccccagagagaacagcaagagctccatgtactacgtgctgcagttcctgaaagaggatctccccaaggtggtggtgcagggcattccagaggtgtccagagctgtcatccacattgacgagcagagtggaaaggagaagtacaagcttctggtggaaggtgataacctgcgggcagtcatggccacacacggtgtgaagggcacccgaaccacctccaataacacctatgaggtggagaaaactctgggcatcgaggccgcccggacaacgatcatcaatgaaatccagtacaccatggtgaaccacggcatgagcatcgacaggaggcacgtgatgctgctctccgacctcatgacctacaagggtgaagtcctgggcatcactaggtttggcctggccaagatgaaggagagtgtgctgatgctggcctcctttgagaagacggctgaccatctctttgacgctgcctacttcgggcagaaggactctgtgtgtggggtgtctgagtgcatcatcatgggaatcccaatgaacattggaaccgggctcttcaagctgcttcacaaggctgacagggacccgaaccctcccaagaggcccctgatcttcgacacaaatgaattccacatcccccttgtcacatagtccaaagaaagaggggaccatgcctgaccttgactccttgtcctgtctccagctgatgtataaagagttttgtgctccctgggacgggggtcctgaggtccccacctatgccagcaatcagagaagccctcttggcatccccaggagcagcttctcctctgatagggtgcagctcacaccagtgaccctgactgtgccacgctgctcgggagagctgagggttttattgtttgcttgcttgaaacctaatctatagacggccccacagctcgtgcacacactgcttccctggacttaaagcccagccaggtgtcatggtccatcccagctcactgcatacatccatcggctccccatggtgtcttcacacctgacgatgagccaggcctgagccccacacaggccagggcacattcttggattttccattccttggtcatgctggaatctctcaatgtgacatacttatgtaaatattgttactattatttatttgttccatttgagggatttggaatttttgttattttagttttatttttgaaaccaagcatctatagaaaccaagaaagtcagcatgtaagcgtcactggaaaaactggtttaagcaaatagagccgtctgggatttgtaactgaggtgcaactgtcatgaggcccaggcagctctgtaacatcttctatagatgcccctggctaccctgttgttttcatctacctcagacccctatcatggggctctaccctgtgacaagagccaaacccattctccatggcctatggaagcctcactggagtttggggcctgctgcaatggggatgagatggttttttgtagaattatacttacgttccttggatgatctctagttgattttttaagttctgagttgatgctgttaaggtacccggggtagccattggttcttggatctgtgttagaatgagtgctttcccttcctactgatgtgattgtggattaggaattcgtgaccgagtgatttttggccagtggttgggtttaaaattctattaaaatttgtagtttgggctgggtgctgtggctcatacctataatcccagcactttgggaggccgaggggggcagatcacttgagcccaggagttcgagagcagcctgggcaacatgacgaaaccccgtctctacagagaatacaaaaattagccaggcatggtggcccatgcctgtagtacctgctattggtaaggctgaggtggaaggttcacttgagcctgggaggtggaggttgtagtgagccaagatcgtgccactacactccagcctgggcaacaaagcaagaccttgtctcaaaaaaaaaaaagaaaaaaattaagcgtaaaaaaaaattagtttttataaaaaattatagtttgaccttttgatttccctgcatctacaaggtagacctattaacttctcttggggtatcagtgatgtggaaaaaaaatgccatttttcttaatgtttaacccccctttatctttgaattgagctagagcctggtttaggacaaaggattaagtttgttaatgaacactaattcagggcttctacttgagaccccaccgagatcaccagttctcatgtaacctgggaagagccataaaggggtaccccccaccccaactgccttcctggaagcatgcctgggaagtaagctgtaggcctgatccgagccaggaccactgggatccgtgcaaaggccaggggagggtagaattgaatcataggagtgaactccggcacctgttgtcttctgcgggtgacgcacactttaaatggaagagaggttgtggctataacttgtggctgggaataataaagatggcaccgccaaggagcctcaccttgcgtgagtgagtactcagttgggcgctgcagggtctggagtctgtgtgagacgtgtgtgattgtgatgggtgcgaatcagcgtatagcacttgagaacaaggcagaccttggagcagaatggttatgtgaaggatcacatcacccatgggtagggggggaagtcatacgtcctggaggtgctggtcctcctcctggaactgccagccttgctaggactatcaacatcaacagcattgcctggtaaaccctactgtttgtgctccccactgtgtcccatgactggtgttaaaattctccctactttgatcatctgccctgcccaggccttgggctttatgccagcacagagctcaaaggccaggtagcagcacatcctcaagcatgagagctcaaagggttacatttgagtctctgtacctgcttggaagaaataaaaatacgtgtgaattccatctca

SEQ ID NO: 167578 - DNA, 1022 bp, Homo sapiens
  Payload ID: 12966
  Gene Symbol: POLR3A
  Gene Name: polymerase (RNA) III (DNA directed) polypeptide A, 155kDa
  ENST ID: ENST00000473588
  CDS Start-End: 1-599
acatcaatttcttgaggaaactggttcaaaacggccctgaggttcacccaggagcaaacttcattcagcagagacatacgcagatgaaaaggtttttgaaatacggaaatcgagaaaagatggctcaagagctcaagtatggtgacatcgtagagagacacctcatcgatggagatgtggtgctgttcaatcggcagccctcgctgcacaaattgagcattatggctcatctggccagggtcaagccccaccggaccttcagatttaatgagtgtgtctgtacaccctataatgctgactttgatggtgatgaaatgaaccttcatcttcctcaaacagaagaagctaaagcagaggcccttgttctgatggggactaaagcaaatcttgtaaccccgaggaatggggaaccgctgattgctgctattcaggattttctaacaggtgcctatctcctcactctcaaggacactttctttgatcgagccaaggcttgccaaatcattgcttcaatactggttggcaaggatgagaaaattaaagttcgcctcccaccgcctacaatcctaaagatgttacaatccagaacagtgagttgatgagtggcagcatggacaaaggaaccctagggtcaggatccaagaacaatattttttacattttgctgcgagactggggacagaatgaagctgcagatgccatgtcacggctcgccaggctggctcctgtctacctgtctaaccgtggtttctcaattgggatcggtgatgtcacacctggccaaggactgctgaaggccaagtatgagttgctgaatgccggctacaagaaatgtgatgagtacatcgaagccctgaacacgggcaagctgcagcagcagcctggctgcactgctgaggagaccctggaggcactgatcctgaaggagctgtctgtgatccgtgaccacgctggcagtgcctgcctccgggagctggacaagagcaacagccccctcaccatggctctgtgcggctccaaag

SEQ ID NO: 167579 - DNA, 1668 bp, Homo sapiens
  Payload ID: 12966
  Gene Symbol: POLR3A
  Gene Name: polymerase (RNA) III (DNA directed) polypeptide A, 155kDa
  ENST ID: ENST00000616246
  CDS Start-End: 392-880
ctgcagtgggtgctctgtgtgcccagagcattggtgagccaggcacccagatgaccctgaagactttccactttgcaggtgtggcctccatgaacatcaccctgggcgtgccccggattaaagagatcatcaacgcttccaaggccatcagcactccaattatcacagcacagctagacaaggatgacgacgcggattatgctcgcctcatgactgctttattctcgtcaagctctccctggaacggattaggcttctgagactggaagtgaacgctgagacagtgagatattccatctgcacatccaagctccgtgtgaagcccggtgatgtggctgttcatggtgaggctgtggtgtgtgtcacccccagagagaacagcaagagctccatgtactacgtgctgcagttcctgaaagaggatctccccaaggtggtggtgcagggcattccagaggtgtccagagctgtcatccacattgacgagcagagtggaaaggagaagtacaagcttctggtggaaggtgataacctgcgggcagtcatggccacacacggtgtgaagggcacccgaaccacctccaataacacctatgaggtggagaaaactctgggcatcgaggccgcccggacaacgatcatcaatgaaatccagtacaccatggtgaaccacggcatgagcatcgacaggaggcacgtgatgctgctctccgacctcatgacctacaagggtgaagtcctgggcatcactaggtttggcctggccaagatgaaggagagtgtgctgatgctggcctcctttgagaagacggctgaccatctctttgacgctgcctacttcgggcagaaggactctgtgtgtgcctggccccaaccctgagacctgtatgaaggtggatagtccacactcagaaaagagaagcaggatggtagtcatggaagctggaatctgccaaggagtatggaacaactcaccagccaaatgaactcgtcctaaaaatatggatctaatttttttaaaaaagaaaaggccaagtgcagtggctcacacccataatcccagcatcccagcacttgggaggccgaggtagatggatcacttgaggtcaggagttcgagatcagcctggccaacatggtgacaccccatctctactaaagatacaaaaattagccaggcatggtggcatgtgcctgtagtcccagctactcgggaggctgaagcatgagaatcgcttggacctgggaggcagaggctgcggtgagccaaaattgcgccaatgcactccagcctgggtgacagaagaagaccctgtttcagggggaaaaaaaagaaaaagaaaggaaagggaaaaaacatgaagagagcccagtgtatccagacccgagtctcatcaccttctcaggaagctttttgggttgtccaggccttaagtaggcctgtgcttccaaacttcatttctgggaggagtgccagtgggctggggaagtcggaggctagaagaagcctgttcttgtaccttgcagtctgttccaccaccgaggaacaggcctgacccgagtggcctgcagtaaagctccgagtcagggagcatggtataatcacctgacactggtgttacaggtaaatcacaatctctccccatagacaacatgatcttcctcatgt

SEQ ID NO: 167580 - DNA, 4273 bp, Homo sapiens
  Payload ID: 12967
  Gene Symbol: POLR3B
  Gene Name: polymerase (RNA) III (DNA directed) polypeptide B
  Uniprot ID: Q9NW08
  ENST ID: ENST00000228347
  CDS Start-End: 223-3624
accagagggcgtactttccttactcggcctcggccacatccgggttccaccgcagattcgggcagggagcgggcggaacctttctaccgcgtctctagctaacacgcacggcggggacagtttaggcctccgcgcaccgttcgccgggagtcttgcagtttgcttggtgcagggaaggcgggcgcggaggttctatctgtttcttcctccttcgtgagcagcatggacgtgctagcggaggagtttgggaacctgactccggagcagctggcggcgccgatcccgactgtagaggaaaaatggaggctgcttccagcatttttaaaggtgaaaggccttgtgaaacagcatatagattcatttaactatttcattaatgtagagataaagaagataatgaaagccaatgaaaaggttacaagtgacgctgaccctatgtggtacttaaaatatcttaatatctatgttgggcttcctgatgttgaagaaagcttcaatgtaactagaccagtgtcccctcatgagtgccgtttgagagacatgacatactctgcccctattacagtggatattgaatatacccgaggcagccagaggatcatccgcaatgccttacctatcggcagaatgcccataatgctacgtagttcaaactgtgttcttacaggaaaaacgccagcagaatttgccaaactgaacgaatgtcccttagatccaggtggctacttcattgttaaaggagtagaaaaagttattcttatccaagagcagctgtctaagaacaggatcatcgtggaggctgatagaaaaggggctgttggagcttcagttaccagctctacccatgagaaaaaaagcagaaccaatatggctgtgaaacaaggacgattttatttgaggcataatactttgtcagaagatatacccattgtcatcatatttaaggccatgggtgttgagagtgaccaggaaattgtgcagatgattggaacagaggagcacgtgatggctgcatttgggcccagtctggaagagtgccagaaagctcagattttcacacagatgcaggcattaaaatatatagggaacaaagtaagaaggcaaaggatgtggggaggtggaccaaagaaaaccaaaatagaagaagcaagagagctcctggcttccaccattctgacccatgtcccagttaaggaattcaatttccgagccaaatgtatctatactgcagtgatggtgcgaagagttattctggcccaaggagataataaagttgacgacagagattattatggtaacaagcgactggaattggcaggacagcttttatctcttctttttgaagacttgttcaaaaaatttaattctgaaatgaaaaagattgccgaccaggtgattcctaagcaaagagcagcccagtttgatgttgtcaaacacatgcgccaagaccagatcaccaatggcatggtgaatgctatttctaccggaaattggtctttaaagagatttaaaatggaccgccagggtgtaacccaagtgctgtctcgcttgtcatatatatccgcactgggcatgatgacaagaatctcttcccagtttgaaaaaacgagaaaagtgagtggtcctcgctccctccagccatctcagtggggaatgctgtgtccttcggacactcctgaaggagaggcatgtggtttggttaaaaacttggcccttatgacacacatcacaactgatatggaagatggacccattgttaaattagccagtaacttgggagtagaagatgtgaatttattatgtggggaagagctctcttacccaaatgtgtttcttgtctttcttaatggtaacatcttaggtgtcattcgagaccacaaaaagctagtgaatacatttcgactcatgagaagagcaggatatatcaatgaatttgtttccatctcaacaaatcttacagatcgatgtgtctatatttcttctgatgggggaaggctatgcagaccctacataattgtcaagaaacagaagccagcagtcacaaataaacatatggaagagctggcccaagggtacaggaattttgaagatttcttacatgagagtctggttgaatatttagatgtgaatgaagaaaatgattgtaacattgcactgtacgaacacacaattaataaagacaccacccacttggagattgaacccttcactcttctcggcgtgtgtgctggacttatcccataccctcaccataaccagtcaccgagaaacacttatcagtgtgccatggggaaacaagccatgggtactataggatacaaccagcgaaacagaattgatactctcatgtatctactagcatatccacaaaaacccatggttaagacaaaaaccattgaattgatagaatttgagaaactgccagctggacagaatgcaacagttgctgtgatgagctatagtggctatgatattgaagatgctcttgttttaaacaaggcctctttagacagaggctttgggcgttgccttgtatataaaaatgctaaatgtacgttgaaacgatacaccaatcagacttttgataaagtgatggggcccatgttggatgctgctacaaggaaacctatctggcgacatgaaatcttagatgcagatggtatttgttctccaggtgagaaagtagaaaacaaacaagtgcttgtaaataagtccatgcccacagtgactcagattcctttggaaggaagtaatgtaccacagcaaccacagtacaaagatgtacccataacctacaaaggagcaacagactcatatattgaaaaagtgatgatatcttcaaatgctgaagatgcttttctgatcaaaatgctgctgagacagacaaggcgtccagaaattggagacaaattcagcagtcgtcatgggcaaaaaggtgtttgtggcttgatcgtcccccaggaagacatgccattttgtgattctggcatctgtccggacatcatcatgaacccacacggcttcccatcacgaatgacggtggggaagctcattgagctgctggctggcaaggccggtgtgctggacggcagattccactacggcactgcgtttggaggcagtaaagtgaaggatgtgtgtgaggacctcgttcgccatggttataactacttggggaaagactatgttacatccggcatcacaggtgagcccttagaagcatacatctattttggccccgtgtactatcagaagctgaaacacatggtgctagataaaatgcatgcccgggcccggggcccacgagccgtccttaccaggcaacccactgaaggacggtctcgtgatggtggcttgcgtctcggggaaatggaacgtgactgtttaatcggttatggagccagtatgcttttgctagagagactaatgatttcaagtgatgcctttgaggttgatgtctgtgggcagtgtggacttctggggtattctggctggtgccattactgcaagtcatcctgccacgtgtcttccctccgtattccgtatgcctgcaagctgctcttccaggaactacagtctatgaacatcatccccaggttaaaactgtccaagtacaatgaatgaggatggaaaaaatgattattaaagagaacaagtgatacatccaatgcaacggaaagcagaagggatttaggactacgtctcctcctgtgaagaattcccttgcgtattctctctctaaaacaaccaaaaaaaaatggagaggctttttatatactctaagactggctaaacaaccttgatcattgagcctcgagccatgggagagatgctgaccatgtggactgcaaggctgcttgattcacagatggatgtgacctaaaggataaataagctattacttatgtgctgatctcttgacattcactcattagaagaccttactccttcaagcaaatgtttggggtcaaatttaccatatcttctggctaaccatattcaagattcttctgaaacttggaggatgtaaagaatccatttgatttggtcagcctggcttttgtcgtggtggctggctcggataaattttcccaacaattaaatcttgcctttacacacccaaactttgtaattttagtcttggtgaaatataatgaatttgttcctaccttgtcaagcaagaatgtcgtcttctcctatggactcaattgctattattttaaacctgcatgattgtaccatgcaatactattcgttaaatatctgaatctaa

SEQ ID NO: 167581 - DNA, 4118 bp, Homo sapiens
  Payload ID: 12967
  Gene Symbol: POLR3B
  Gene Name: polymerase (RNA) III (DNA directed) polypeptide B
  Uniprot ID: Q9NW08
  ENST ID: ENST00000539066
  CDS Start-End: 244-3471
agagcgtcgcgcttgcgagtcttttttccagagccggcctccgcgtgcgcgagtgaaggctgatcccagaggagctgtcagccgctgcgggggccgagaagccccgctgctggctctagggttggagctcttccagcataggaaaaatggaggctgcttccagcatttttaaaggtgaaaggccttgtgaaacagcatatagattcatttaactatttcattaatgtagagataaagaagataatgaaagccaatgaaaaggttacaagtgacgctgaccctatgtggtacttaaaatatcttaatatctatgttgggcttcctgatgttgaagaaagcttcaatgtaactagaccagtgtcccctcatgagtgccgtttgagagacatgacatactctgcccctattacagtggatattgaatatacccgaggcagccagaggatcatccgcaatgccttacctatcggcagaatgcccataatgctacgtagttcaaactgtgttcttacaggaaaaacgccagcagaatttgccaaactgaacgaatgtcccttagatccaggtggctacttcattgttaaaggagtagaaaaagttattcttatccaagagcagctgtctaagaacaggatcatcgtggaggctgatagaaaaggggctgttggagcttcagttaccagctctacccatgagaaaaaaagcagaaccaatatggctgtgaaacaaggacgattttatttgaggcataatactttgtcagaagatatacccattgtcatcatatttaaggccatgggtgttgagagtgaccaggaaattgtgcagatgattggaacagaggagcacgtgatggctgcatttgggcccagtctggaagagtgccagaaagctcagattttcacacagatgcaggcattaaaatatatagggaacaaagtaagaaggcaaaggatgtggggaggtggaccaaagaaaaccaaaatagaagaagcaagagagctcctggcttccaccattctgacccatgtcccagttaaggaattcaatttccgagccaaatgtatctatactgcagtgatggtgcgaagagttattctggcccaaggagataataaagttgacgacagagattattatggtaacaagcgactggaattggcaggacagcttttatctcttctttttgaagacttgttcaaaaaatttaattctgaaatgaaaaagattgccgaccaggtgattcctaagcaaagagcagcccagtttgatgttgtcaaacacatgcgccaagaccagatcaccaatggcatggtgaatgctatttctaccggaaattggtctttaaagagatttaaaatggaccgccagggtgtaacccaagtgctgtctcgcttgtcatatatatccgcactgggcatgatgacaagaatctcttcccagtttgaaaaaacgagaaaagtgagtggtcctcgctccctccagccatctcagtggggaatgctgtgtccttcggacactcctgaaggagaggcatgtggtttggttaaaaacttggcccttatgacacacatcacaactgatatggaagatggacccattgttaaattagccagtaacttgggagtagaagatgtgaatttattatgtggggaagagctctcttacccaaatgtgtttcttgtctttcttaatggtaacatcttaggtgtcattcgagaccacaaaaagctagtgaatacatttcgactcatgagaagagcaggatatatcaatgaatttgtttccatctcaacaaatcttacagatcgatgtgtctatatttcttctgatgggggaaggctatgcagaccctacataattgtcaagaaacagaagccagcagtcacaaataaacatatggaagagctggcccaagggtacaggaattttgaagatttcttacatgagagtctggttgaatatttagatgtgaatgaagaaaatgattgtaacattgcactgtacgaacacacaattaataaagacaccacccacttggagattgaacccttcactcttctcggcgtgtgtgctggacttatcccataccctcaccataaccagtcaccgagaaacacttatcagtgtgccatggggaaacaagccatgggtactataggatacaaccagcgaaacagaattgatactctcatgtatctactagcatatccacaaaaacccatggttaagacaaaaaccattgaattgatagaatttgagaaactgccagctggacagaatgcaacagttgctgtgatgagctatagtggctatgatattgaagatgctcttgttttaaacaaggcctctttagacagaggctttgggcgttgccttgtatataaaaatgctaaatgtacgttgaaacgatacaccaatcagacttttgataaagtgatggggcccatgttggatgctgctacaaggaaacctatctggcgacatgaaatcttagatgcagatggtatttgttctccaggtgagaaagtagaaaacaaacaagtgcttgtaaataagtccatgcccacagtgactcagattcctttggaaggaagtaatgtaccacagcaaccacagtacaaagatgtacccataacctacaaaggagcaacagactcatatattgaaaaagtgatgatatcttcaaatgctgaagatgcttttctgatcaaaatgctgctgagacagacaaggcgtccagaaattggagacaaattcagcagtcgtcatgggcaaaaaggtgtttgtggcttgatcgtcccccaggaagacatgccattttgtgattctggcatctgtccggacatcatcatgaacccacacggcttcccatcacgaatgacggtggggaagctcattgagctgctggctggcaaggccggtgtgctggacggcagattccactacggcactgcgtttggaggcagtaaagtgaaggatgtgtgtgaggacctcgttcgccatggttataactacttggggaaagactatgttacatccggcatcacaggtgagcccttagaagcatacatctattttggccccgtgtactatcagaagctgaaacacatggtgctagataaaatgcatgcccgggcccggggcccacgagccgtccttaccaggcaacccactgaaggacggtctcgtgatggtggcttgcgtctcggggaaatggaacgtgactgtttaatcggttatggagccagtatgcttttgctagagagactaatgatttcaagtgatgcctttgaggttgatgtctgtgggcagtgtggacttctggggtattctggctggtgccattactgcaagtcatcctgccacgtgtcttccctccgtattccgtatgcctgcaagctgctcttccaggaactacagtctatgaacatcatccccaggttaaaactgtccaagtacaatgaatgaggatggaaaaaatgattattaaagagaacaagtgatacatccaatgcaacggaaagcagaagggatttaggactacgtctcctcctgtgaagaattcccttgcgtattctctctctaaaacaaccaaaaaaaaatggagaggctttttatatactctaagactggctaaacaaccttgatcattgagcctcgagccatgggagagatgctgaccatgtggactgcaaggctgcttgattcacagatggatgtgacctaaaggataaataagctattacttatgtgctgatctcttgacattcactcattagaagaccttactccttcaagcaaatgtttggggtcaaatttaccatatcttctggctaaccatattcaagattcttctgaaacttggaggatgtaaagaatccatttgatttggtcagcctggcttttgtcgtggtggctggctcggataaattttcccaacaattaaatcttgcctttacacacccaaactttgtaattttagtcttggtgaaatataatgaatttgttcctaccttgtcaagcaagaatgtcgtcttctcctatggactcaattgctattattttaaacctgcatgattgtaccatgcaatactattcgttaaatatctgaatct

SEQ ID NO: 167582 - DNA, 580 bp, Homo sapiens
  Payload ID: 12967
  Gene Symbol: POLR3B
  Gene Name: polymerase (RNA) III (DNA directed) polypeptide B
  ENST ID: ENST00000549569
  CDS Start-End: 72-580
aaactgtcactgcgctagtaggagtgtgaggatgaccagaggtcactctcatcaccatcttggttttggccatgggtgttgagagtgaccaggaaattgtgcagatgattggaacagaggagcacgtgatggctgcatttgggcccagtctggaagagtgccagaaagctcagattttcacacagatgcaggcattaaaatatatagggaacaaagtaagaaggcaaaggatgtggggaggtggaccaaagaaaaccaaaatagaagaagcaagagagctcctggcttccaccattctgacccatgtcccagttaaggaattcaatttccgagccaaatgtatctatactgcagtgatggtgcgaagagttattctggcccaaggagataataaagttgacgacagagattattatggtaacaagcgactggaattggcaggacagcttttatctcttctttttgaagacttgttcaaaaaatttaattctgaaatgaaaaagattgccgaccaggtgattcctaagcaaagagcagcccagtttgatgttgtcaaacacatgcgccaagaccagatcac

SEQ ID NO: 167583 - DNA, 1851 bp, Homo sapiens
  Payload ID: 12968
  Gene Symbol: POLR3C
  Gene Name: polymerase (RNA) III (DNA directed) polypeptide C (62kD)
  Uniprot ID: Q9BUI4
  ENST ID: ENST00000334163
  CDS Start-End: 162-1766
gtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcattatttgcagtggga

SEQ ID NO: 167584 - DNA, 1590 bp, Homo sapiens
  Payload ID: 12968
  Gene Symbol: POLR3C
  Gene Name: polymerase (RNA) III (DNA directed) polypeptide C (62kD)
  ENST ID: ENST00000369294
  CDS Start-End: 215-1450
cggaagccgccgaaactctggggtagagtggcacgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcatta

SEQ ID NO: 167585 - DNA, 1931 bp, Homo sapiens
  Payload ID: 12969
  Gene Symbol: POLR3D
  Gene Name: polymerase (RNA) III (DNA directed) polypeptide D, 44kDa
  Uniprot ID: P05423
  ENST ID: ENST00000306433
  CDS Start-End: 86-1282
aagatggcggcgcccaggccctgccacgcagacttccgcccggcgcggagaccgaaggctggcggctggtcgcgttgcaggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtgaaagggacagagaccgacaacgagaggggcatggacgagggcgaggccgtccagaagtgatccagtctcactccatctttgagcagggcccagctgaaatgatgaagaaaaaagggaactgggataagacagtggatgtgtcagacatgggaccttctcatatcatcaacatcaaaaaagagaagagagagacagacgaagaaactaaacagatcttgcgtatgctggagaaggacgatttcctcgatgaccccggcctgaggaacgacactcgaaatatgcctgtgcagctgccgctggctcactcaggatggctttttaaggaagaaaatgacgaaccagatgttaaaccttggctggctggccccaaggaagaggacatggaggtggacatacctgctgtgaaagtgaaagaggagccacgagatgaggaggaagaggccaagatgaaggctcctcccaaagcagccaggaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtaaaatgagcaggtggaggaggacggcgcctgtgcccacggctgctgcctgctccagacattttgttcttgaatctgtgagacccagaaggggcccactgagcccactcactccagcctttggcaaccattgttccaggtcccccagggcttcctcccacagcagctgtgaatggcacagtgaccttcctgcagcgtggagatggcacatccttgctgctggggacttggccctgctatttatttttgtatttatgtcttaatctcttccactgatgcatcctccaagggtagatggggagggtctgtgtgaaggggccggcttctcttggtgcctgctgggttgcaggggcaggaagcgtgtggactgcagcttctgctggtgctccccccgtcctcctggaggcagtataggagagagagcaaggattgagtctgagacttaagcactcggtcccagcttgccagttcctggttctgtgtccttggacaaactacctaacctttctgagcctcctatacctcatccgacacaaatggggatgatacctacctccagggttggcgtgaggattcatgggctattatagatgaaaactgcacaaggccagaaccagcaggcactcaataaacgttcatgtcctttttctcta

SEQ ID NO: 167586 - DNA, 5494 bp, Homo sapiens
  Payload ID: 12969
  Gene Symbol: POLR3D
  Gene Name: polymerase (RNA) III (DNA directed) polypeptide D, 44kDa
  Uniprot ID: P05423
  ENST ID: ENST00000397802
  CDS Start-End: 216-1412
ggttcctgggcggggttcctggagagggcgtgtcgcgagccaaaggctctcacctgggtggtcccgggagtctcgccacgtgggaggggaggagctgagaggccactggagggacgcaccgactgggggaccggaaagcaagggggtggggttccgccagggtccgcgtgtcagtcccctctggtgatctcgtcgccccttctctcccaggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtgaaagggacagagaccgacaacgagaggggcatggacgagggcgaggccgtccagaagtgatccagtctcactccatctttgagcagggcccagctgaaatgatgaagaaaaaagggaactgggataagacagtggatgtgtcagacatgggaccttctcatatcatcaacatcaaaaaagagaagagagagacagacgaagaaactaaacagatcttgcgtatgctggagaaggacgatttcctcgatgaccccggcctgaggaacgacactcgaaatatgcctgtgcagctgccgctggctcactcaggatggctttttaaggaagaaaatgacgaaccagatgttaaaccttggctggctggccccaaggaagaggacatggaggtggacatacctgctgtgaaagtgaaagaggagccacgagatgaggaggaagaggccaagatgaaggctcctcccaaagcagccaggaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtaaaatgagcaggtggaggaggacggcgcctgtgcccacggctgctgcctgctccagacattttgttcttgaatctgtgagacccagaaggggcccactgagcccactcactccagcctttggcaaccattgttccaggtcccccagggcttcctcccacagcagctgtgaatggcacagtgaccttcctgcagcgtggagatggcacatccttgctgctggggacttggccctgctatttatttttgtatttatgtcttaatctcttccactgatgcatcctccaagggtagatggggagggtctgtgtgaaggggccggcttctcttggtgcctgctgggttgcaggggcaggaagcgtgtggactgcagcttctgctggtgctccccccgtcctcctggaggcagtataggagagagagcaaggattgagtctgagacttaagcactcggtcccagcttgccagttcctggttctgtgtccttggacaaactacctaacctttctgagcctcctatacctcatccgacacaaatggggatgatacctacctccagggttggcgtgaggattcatgggctattatagatgaaaactgcacaaggccagaaccagcaggcactcaataaacgttcatgtcctttttctctacctgagtctattttcaaacaaaatagagattctaaatctcccagaagcagcgactagagctgctcccgtccccactcttgccccttcctgctttatatcccgtcctcaccctgggcctgatgccctaaatttatggtgtcagattgttctatgcctttttctcctggctcctgttagccaggtgcctcctgtgtgagttactgtaatagctgcaggtaatagaaaggaagaagtcagagacccctcccagcaccctacaaaagcctttgggggacatgttgggcccaggacatgttccctgcactctttcctttgcagttagtactcatgtatgagccgaagtcatatattgctaacaaaaaaactaaatccttcataagagaagttagggatgtattgaataatggcctctttgacacttggccgatgatgcccacttcaaaaactttgggtttcagaggcctgcccgtctcctgtcctagcactgccagagccacctactcagtgttacttttttgggtctgtgatcctgttccctttaccaggtcattgtactgtgttgtccctggaggaacagcttctcctcttgtcttgacagtagggctggggttttccctggttcagctggggagacgtttgcaggttagaaaaaggtctcatgcggcagcgtgtgtggctgttagacgctgatggcacaacttccctttgctggcgtcgtggcacctggcctctgggacagtatgaaccataggggctcaggaagaaccgcttcccctccacccccatccctgattcctagtggccccttagattttgggtacatcttccttcaggctcaccttccttcttttcaaagttcctcaagcctgttactcatttgtcaaggctgggcttctcctacaaagccctcaacctgcccagccagcagctgtgaggctgactgaatatttggtgaccatatcaccctttctggtgctgaagctcatgtcagctccattggacagtgttattctgggctcttctcactgtagaggactggagcagaaagggttccttggaaacctgtgctgggaagccctgtttggtctaaggctaagctttggttaactctgggctccagccctttcttcctttaaatagctgatgcacggccagcaggtctccattctcatcctctctttctattctgtttctttggttcagaaatactcttctgctttttttggacgaactcaatggcccgatgttagatattgggtatttttcaatcttctgttttctgacccttccaagaaagtttgaggaagaacatgtactgctttcacgttcatttcgcccattcagatgtcttggcttgaaccttatgactccgtatcaaagtcctcacaacctgtctcagatccctgatgcacaaattaggtcttattaataagtgtgggaaaagagaggagagtccaccttcttggtcaggcccctgaggcatgcatttctaccaaggaatatggacagatgacagaggagaagagcccaaagccaaatttatacatgagtgcaagtggatgcaaatttgttgctccctgcatctgtgtatatgctttctgttaaatacagaaagaaggaacaataggcttgcacacttttctaactacatgtttaagtggcagagtccaggctgtcgagtcacggttgggtttgaatctgactccaccagtaactttggttggaaaaaatcacttatcctctttaagcttgattttatttattttattttatgtaagagtgagacagtagtagcttaatagggttgcttttaaattagagtgaacatgaggcatttattcggtgccagacagataactgcctataacaggatgtgatcagcacaagtaacagaaaattagcctgacggtggcttaagcaatgggaatgtttatctcacatagcaaaaagtctgtaaatagatggttctagagttgggtggaagccaaaatgtcatcaggatttccttggaaccgtctgctttgccatcctcagtattgcagaatggctgctcctgcgccaagcatcattctgcaaatgatggtgtccacagccagagtggacagtagtacaggagccttctcattctgcccttatccgggaataaccgtcagcagctccagcaacctcccccctgtctctttatagagtggggccacgtgcccactcttggaccaggccctggcaaagggggatgggtcgactagtgtatcccctggcactgagcacacttgcccttgagctggggttttgttagtagggaggaagctggagtggcagttggatagacaattcatagtagctgctgccatgttcaaaaaatgctgcaatgtaaaatcataaagtattcatctaggcataactttttaaaatattcagtcaccttttattctactaaaatcaattttaacattttagtgtatattattttattttagattcagcaggtacatgagcatgttagttttgttttgttttgttttgttctgttttgttttttgagatggagtctcactctgtcgcccagtggtgtgatcttggcttactgcaactctgtctcccaggttcaagtgatcctcccgcctcagccccccagatagctgggattacaggcacatgccaccacacctggctaatttttgtatttttagtagagacgggagtttcaccatgttggccaggctggtctcaaactcctcacctcaagtgatctacctgcctcagcctcccaagtgctgggattacaggcgtgagccactgcgcccagccacatgtgcgtgtttgtgtatattgcgtactggtggggattgggcttctgtcatacctatcacccaaatagtgaacattgtactcaggtagcatttcaacccttgccccccctcccactcacccccttttggagtgcccagtgtttgctatttccatctttatgtccataggtacccattatttagctcccacttataagtgagaacatgtgctatttgattttctgtttccgaggttaggataattacctcaagctccatccatgtggctgcaaagcacatgatttcattgtattttatgactgctcatgtatattatttcagcctccaaaattttgtatgttatttataatgatataaattatgtggttttatcgtgtactctatctcactcagaaatacatacaattcttcgttcccagctactctggagctgaggtgggaggatcacttgagcccaggagttcaagaccagcctgggcaacatggtgaaaccttgtctctgaaaaataaataatacacacccacatgcacacacatccagttcttccatgttaatgagtatgttgtgtttcacatacttctgaattagccgaaggaattaaaggtagcatcttttaatcctc

SEQ ID NO: 167587 - DNA, 683 bp, Homo sapiens
  Payload ID: 12969
  Gene Symbol: POLR3D
  Gene Name: polymerase (RNA) III (DNA directed) polypeptide D, 44kDa
  ENST ID: ENST00000519237
  CDS Start-End: 61-683
cggctggtcgcgttgcaggtgaggttgtgacgcgcggtgtggagccgcggcccgggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtgaaagggacagagaccgacaacgagaggggcatggacgagggcgaggccgtccagaagtgatccagtctcactccatctttgagcagggcccagctgaaatgatgaagaaaaaagggaactgggataagacagtggatgtgtcagacatgggaccttctcatatcatcaacatcaaaaaagagaagagagagacagacgaagaaactaaacagatcttgcgtatgctggagaaggacgatttcctcgatgaccccggcctgaggaacgacactcgaaatatgcctgtgcagctgccgctggctcactcaggatggctttttaaggaagaaaatgacgaaccagatgttaaaccttggctggctggccccaaggaaga

SEQ ID NO: 167588 - DNA, 1202 bp, Homo sapiens
  Payload ID: 12969
  Gene Symbol: POLR3D
  Gene Name: polymerase (RNA) III (DNA directed) polypeptide D, 44kDa
  ENST ID: ENST00000518039
  CDS Start-End: 19-390
ccttctctcccaggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtgaaagggacagagaccgacaacgagaggggcatggacgagggcgaggccgtccagaagtgatccagtctcactccatctttgagcagggcccagctgaaatgatgaagaaaaaagttcctcgatgaccccggcctgaggaacgacactcgaaatatgcctgtgcagctgccgctggctcactcaggatggctttttaaggaagaaaatgacgaaccagatgttaaaccttggctggctggccccaaggaagaggacatggaggtggacatacctgctgtgaaaggaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtaaaatgagcaggtggaggaggacggcgcctgtgcccacggctgctgcctgctccagacattttgttcttgaatctgtgagacccagaaggggcccactgagcccactcactccagcctttggcaaccattgttccaggtcccccagggcttcctcccacagcagctgtgaatggcacagtgaccttcctgcagcgtggagatggcacatccttgctgctggggacttggccctgctatttatttttgtatttatgtcttaatctcttccactgatgcatcctccaagggtagatggggagggtctgtgtgaaggggccggcttctcttggtgcctgctgggttgcaggggcaggaagcgtgtggactgcagcttctgctg

SEQ ID NO: 167589 - DNA, 3697 bp, Homo sapiens
  Payload ID: 12970
  Gene Symbol: POLR3E
  Gene Name: polymerase (RNA) III (DNA directed) polypeptide E (80kD)
  Uniprot ID: Q9NVU0
  ENST ID: ENST00000299853
  CDS Start-End: 168-2294
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcgcagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaactagcatcatggtgctatcttcaaatggttacaggaaggcgatcttgttgggctcagcgttacgtgtatctagagggaacggagctaatggaggaagacagagcagcactgtccactagaaagaggcgagtcacgtacataattttgaaagtttctagcaaccacattagtttaaaaaggtcatgttagcatattatttagctcaaaatatctaaaacatcaacataaggtaaaagtcttcaaaatctggcattttacactttcctcaacactcagtttggactagccacatcataagtgctccgatgccacatggggctatttgcgacagtattggatagcacagccctagaaactgatggaaaaaataagagtaagctaggttggatgacatgtgaattttggtatctagataaggctttcgccatcttttttgtacaacacagtcactaattgtctgaaggtttaaatgacggtctatgctatttccccactccccccaaaataaaacatctaatattttagctatagaatcactaaggcattgatcaaggatgtactttgccaaataagtatttggtaacatcacttaacaagttgatcgtgtattgattctgttaacatatgtgaacctgaaaagtaaagttaccaaaagcgatttggaa

SEQ ID NO: 167590 - DNA, 2469 bp, Homo sapiens
  Payload ID: 12970
  Gene Symbol: POLR3E
  Gene Name: polymerase (RNA) III (DNA directed) polypeptide E (80kD)
  Uniprot ID: Q9NVU0
  ENST ID: ENST00000359210
  CDS Start-End: 144-2144
cagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcgcagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaa

SEQ ID NO: 167591 - DNA, 2529 bp, Homo sapiens
  Payload ID: 12970
  Gene Symbol: POLR3E
  Gene Name: polymerase (RNA) III (DNA directed) polypeptide E (80kD)
  Uniprot ID: Q9NVU0
  ENST ID: ENST00000418581
  CDS Start-End: 150-2168
ctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcgcagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgcc

SEQ ID NO: 167592 - DNA, 645 bp, Homo sapiens
  Payload ID: 12970
  Gene Symbol: POLR3E
  Gene Name: polymerase (RNA) III (DNA directed) polypeptide E (80kD)
  ENST ID: ENST00000565551
  CDS Start-End: 1-191
actattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgcc

SEQ ID NO: 167593 - DNA, 565 bp, Homo sapiens
  Payload ID: 12970
  Gene Symbol: POLR3E
  Gene Name: polymerase (RNA) III (DNA directed) polypeptide E (80kD)
  ENST ID: ENST00000565358
  CDS Start-End: 149-565
ggagtttctccaccagcaacatggccgccgcctgagaggagagccgggccgccgccgtctctgcagcccgcgggtaactgggccgttgccgccgtccgcgctcggcccccgcggagagttgaggaaactgaagcactgagaagccttcatggagcttacgttctattgcagaagacaaacaacacctgagcaaatagaccagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctg

SEQ ID NO: 167594 - DNA, 662 bp, Homo sapiens
  Payload ID: 12970
  Gene Symbol: POLR3E
  Gene Name: polymerase (RNA) III (DNA directed) polypeptide E (80kD)
  ENST ID: ENST00000569757
  CDS Start-End: 392-662
aggcagctctgggagggacacggttggaacggaatttaaacgacctgtgctaggaaaggaagggagagtggaaaacccctatacggagttctctggtcttctggcaggggctgagacggcagtccagcaagggtcacaggcctgacggtatgacctcttccccttcccaccgcaggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggact

SEQ ID NO: 167595 - DNA, 473 bp, Homo sapiens
  Payload ID: 12970
  Gene Symbol: POLR3E
  Gene Name: polymerase (RNA) III (DNA directed) polypeptide E (80kD)
  ENST ID: ENST00000563024
  CDS Start-End: 177-473
agcaacatggccgccgcctgagaggagagccgggccgccgccgtctctgcagcccgcgggtaactgggccgttgccgccgtccgcgctcggcccccgcggagagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctg

SEQ ID NO: 167596 - DNA, 2327 bp, Homo sapiens
  Payload ID: 12970
  Gene Symbol: POLR3E
  Gene Name: polymerase (RNA) III (DNA directed) polypeptide E (80kD)
  ENST ID: ENST00000564750
  CDS Start-End: 16-294
tggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcgcagggtcagcttaagttagttagatcactcccagaagagaccagctgggaccttctttgcagtac

SEQ ID NO: 167597 - DNA, 560 bp, Homo sapiens
  Payload ID: 12970
  Gene Symbol: POLR3E
  Gene Name: polymerase (RNA) III (DNA directed) polypeptide E (80kD)
  ENST ID: ENST00000564883
  CDS Start-End: 231-560
caccagcaacatggccgccgcctgagaggagagccgggccgccgccgtctctgcagcccgcgggtaactgggccgttgccgccgtccgcgctcggcccccgcggagagttgaggaaactgaagcactgagaagccttcatggagcttacgttctattgcagaagacaaacaacacctgagcaaatagaccagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaac

SEQ ID NO: 167598 - DNA, 575 bp, Homo sapiens
  Payload ID: 12970
  Gene Symbol: POLR3E
  Gene Name: polymerase (RNA) III (DNA directed) polypeptide E (80kD)
  ENST ID: ENST00000561494
  CDS Start-End: 143-331
agcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagatgggaaaactgaaggaacacaggagaggcagaagtgtgcagcagttaaagctggggctctggggtcagaccggattgagatccaactccatcacaccatagctgcgagaccgtggtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttccca

SEQ ID NO: 167599 - DNA, 2464 bp, Homo sapiens
  Payload ID: 12970
  Gene Symbol: POLR3E
  Gene Name: polymerase (RNA) III (DNA directed) polypeptide E (80kD)
  Uniprot ID: Q9NVU0
  ENST ID: ENST00000564209
  CDS Start-End: 166-2229
gtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcgcagggtcagcttaagttagttagatcactcccagaagagaccagctgggaccttctttgcagtac

SEQ ID NO: 167600 - DNA, 3655 bp, Homo sapiens
  Payload ID: 12970
  Gene Symbol: POLR3E
  Gene Name: polymerase (RNA) III (DNA directed) polypeptide E (80kD)
  ENST ID: ENST00000615879
  CDS Start-End: 236-2254
aagaggaaacgctggggccggcccgctcccccccacgtgtccgccggagtttctccaccagcaacatggccgccgcctgagaggagagccgggccgccgccgtctctgcagcccgcgggtaactgggccgttgccgccgtccgcgctcggcccccgcggagagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcgcagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaactagcatcatggtgctatcttcaaatggttacaggaaggcgatcttgttgggctcagcgttacgtgtatctagagggaacggagctaatggaggaagacagagcagcactgtccactagaaagaggcgagtcacgtacataattttgaaagtttctagcaaccacattagtttaaaaaggtcatgttagcatattatttagctcaaaatatctaaaacatcaacataaggtaaaagtcttcaaaatctggcattttacactttcctcaacactcagtttggactagccacatcataagtgctccgatgccacatggggctatttgcgacagtattggatagcacagccctagaaactgatggaaaaaataagagtaagctaggttggatgacatgtgaattttggtatctagataaggctttcgccatcttttttgtacaacacagtcactaattgtctgaaggtttaaatgacggtctatgctatttccccactccccccaaaataaaacatctaatattttagctatagaatcactaaggcattgatcaaggatgtactttgccaaataagtatttggtaacatcacttaacaagttgatcgtgtattgattctgttaacatatgtgaacctgaaaagtaaagttaccaaaagcgatttgg

SEQ ID NO: 167601 - DNA, 2416 bp, Homo sapiens
  Payload ID: 12971
  Gene Symbol: POLR3F
  Gene Name: polymerase (RNA) III (DNA directed) polypeptide F, 39 kDa
  Uniprot ID: Q9H1D9
  ENST ID: ENST00000377603
  CDS Start-End: 381-1331
ccgcagggagcctggtacccgcctggagttcctttcccagtgctttcccataggcatctaagaatattccttcacagagttgccaagtgctaaaagttggtttcccaactcagaatgaaggaaccaggcttgtgcgtccgatgggcattgacattctggaaaacaagaataagaagctgtagcggcgcctgtaagtgggccggagcaggcgcagcttggccacctcccgccgaaaggcaaggaaggaccggctgcgacacgaggaagaaggcccctcggcctcagcagagcgctatcctccactggttccccgggttccccggcttgctaccgggctgctccgtgcatctttccccccaggcgtcaggaactgcgccctcatggcggaggtgaaggtgaaggtgcagccgcctgacgcggatccggtcgaaatagaaaacaggattatagaattatgtcaccagttccctcatggaatcacagaccaagtaattcagaatgaaatgcctcatatagaagcccagcagcgggcagtagccatcaataggttgttgtctatgggtcagttggatctcttaaggagcaatacgggccttttatatagaataaaggactctcagaatgctggtaaaatgaagggatccgataaccaagaaaaactagtatatcaaatcatagaggatgcaggaaataaaggaatatggagcagagatatccgctataaaagtaatttgccattaacagaaatcaacaaaattctgaagaatctggaaagtaaaaagcttatcaaagctgttaagtctgtagcagcctcaaaaaagaaggtgtatatgctctataacctgcagccagaccggtctgtgactggtggagcctggtacagtgaccaggattttgaatctgaatttgtagaggtgcttaaccaacagtgttttaaattcctacagtccaaggcagaaacagcacgagaaagcaaacagaacccaatgatacaaagaaatagttcatttgcctcatcacatgaagtgtggaaatatatctgcgaattgggaatcagtaaggtagagttatccatggaagacattgaaaccatcctgaatacactcatttatgatggaaaagtggagatgacgattattgctgcaaaagaaggcacagttggcagtgtagatggacacatgaaactgtacagggcagtcaatccaatcatccctcccacaggtttggtccgggcaccctgtggactctgcccggtttttgatgactgccacgaaggtggtgagatttcaccatctaactgtatttacatgacagagtggctcgaattttaatagagagctatgaactttattgacattttgcaaatgaagttacttagggagcagataatttaattcatgatggaacacgaaatctccttgaaagcaaacttcacaataatggacgtagacttgctgctatgaaaacatattttttttatttatgaagactaaatttatattggtaaaatagccagtagaatatgaaagaaataaggttagtagtgaaattcattcttcaataaataaaacactttgaaactccggaggaccacatctttcaagacttctgatgggtcaaggaaaaagatgccaacatacccgtatttaccaagtactatgataatggctagagtataaaaatgttctttttaaagttatttattaagttcttcattggaagtttttttttatatctggttcactaccaccattttctgtttcctactttctcagtggtttcattgaaaagaaattagaaggggttaaaggcaggaatagcaaagagtgcaaacttggggtatgactgggggagagtggaacatgccttttccgcacaatattaattcctttttgtatcagaaatgttcttttaggagattatgctaccatacttacttcaaacccaatgactactgtcaaggacatattttcagtacataaatactatcattttcattctaaagaatattttcactgttccttctttcttaaagtcttatgtttcactctttaactcaaatgtattctttgttagaatttaccctagattcttatttaatgtctgcagtagactgaatgtttgtgtgcccccagaattctaatgttgaaatctcatttccaatgtgatggtatttggaggtggggcttttggtaagtgataggtcaggagagtaacagcgctcatgaatgggattagtgcccttatataaagagacccagagagctccatcaccccttctgccatgtgaaagggagaagacaaacatccacgaaccaggaagtgggtcctcaccagaaaacaaatctgtaagcaccttgatcttggacttctcagcctccagaattgtgagaaataaatttctgttgttgataaa

SEQ ID NO: 167602 - DNA, 3285 bp, Homo sapiens
  Payload ID: 12972
  Gene Symbol: POLR3G
  Gene Name: polymerase (RNA) III (DNA directed) polypeptide G (32kD)
  Uniprot ID: O15318
  ENST ID: ENST00000399107
  CDS Start-End: 201-872
actccgcggtcctggtgccgcgtgcaggtcggtgcgcgcttctcccgaggtggaacgggcggcagtcaagcgccggcgttctctgccgtcaccctttccttgccggccggcacttcggctgcagagttttgcccacgcttcgagacttagggagcagtgcctttcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgatacagattataaaccagtgccactgaaaacaggagaaggtgaagaatatatgctggctttgaaacaggagttgagagaaacaatgaaaagaatgccttattttattgaaacacctgaagaaagacaagatattgaaaggtatagtaaaagatacatgaaggtatacaaggaagaatggataccagattggagaagacttccaagagagatgatgccaagaaataaatgtaaaaaagcaggcccaaaacccaaaaaggcaaaagacgcaggcaaaggcacaccactcactaatactgaagatgtgttgaaaaaaatggaggaattggaaaaaagaggtgatggtgaaaaatcagatgaggaaaatgaagagaaagaaggaagcaaagagaaaagtaaagaaggtgatgatgacgatgacgatgatgccgcagaacaggaggaatatgatgaagaagagcaagaagaggaaaatgactacattaattcatactttgaagatggagatgattttggcgcagacagtgatgacaacatggatgaggcaacctattaggcatgaaatttttcaaaaaatatttttatgatgcagcttctgaacatttggacagacttgatttgtattttatttctgataaggaataagtacttgtttctgttgttttggacaaatagttgttaccaaaatattcaaaaccactttgagtttacatactagttaccttaaaaattattccctgacactctgacattccttctaaacacctctgccatctctcttatgtactctcatgggtttttttgtatgatttgaatatgaatgtgcctaaagaatttttgctctcttaatctatgtatacatacttgaacaaatcattcttgcttaactgctgatcttttgtaaaactattgctagtcataatggatttctataacctgaaagttgatataatacagcacgtggagcactttaaaaacaaagaaacttgaaaataattttattttttacctttacatggtgtgttctagactactgcattatgactacataaacctacctgagctcttacaagtacagaattgtgagacagaggttttgtgatggaaaacatacacatagggaaaaataccaaactgagcaatataaatttcacagctcacatcttagccagtacaaagaaactttcacatggggtgaatattataatacttgaatttgagacttaatactgtatatgaattaatcatcccactgtaataactgacatcttcaaatagttgggcttatgaaaaatttgactaagacattttattttatactttatgtaaatgtgaaataagttctggtcatataaatatgtagaatgcatgtgtgtgaactctatgaagtgaagtgtggtggccttttatgtttcagagtactcaagtgtacaattgatttatataaaaatgcaaaatgaactcaggtcattttgaaattaatattaatatttttgttgtttaactttaaagctagctcccctaactttatatattttttgggaaaaaatacctaaaaacctcagcctacaaagactctcagaaatgccaaagattttcaaggaaattcatattatatatttcaaaaatgatttatcaatgttatctaccaaaagaaataattttatttttcccctttggggagatattatcctctaatatgagaatcagatccctagattctatttctacctatactattaaactcaaccttgaacctgagcttggttgtttctgtgccttagtttctccactcgtaaacaatttcctataaaaattgtttaaacaccaaccaaaatttaccatatgtattcattctcttgccttaaagatcacttcttaacttacatttggctctcaccctctaaaaatttgtagtttggagagtaactgaaagcacaattttaagaaacatgttttcctcacaaaatatattgtaatctgattttcctatcttgtattcatgcagaaaattggagaaaatgtgtattgtcttgtgccattctgcaatatgaatttctcaggaaaaagatgtttcaatggcaatactttcttaaataattcaagatgggtgtgaggacctatcttattagtttagtgctgtgttaaccatttgtgaattacttcttgtttaaaggaagttgtcaaaaaattttaagattctaaatggaatacacgaataaagtaagccttagaatagaaacctcacaaaaagttgtcatttgcggttgataattaacataggtgttttattctctcaactccttagtaccagagccaaatacaatttagttttcagaaatcttatcaatattgttctatttacctacttataaatctgcagataaccacttgaaccaggcaaatacactgaagataaaggttatttctttttttagctttgaatttgtcatgaccattttagtcttgcagatagcagggcagccccttggggcaaggatttactctgggaggtaccgttaagagccttctttccccctttgaaagatccttttacaatgttaaagtatactagttgcaagaacaagcaggatttgcaggttgctttaccagcatgagtctcatttttctggcttaaaatctgggactgtgaaattattccataggaaagtgaatgttattttgcagaattagcctcttacataaaagtatttgttgaagtgtctttaaaattgctatcatgagcaaaactggttgctgtaatgcttgtttttctgtatttatttacacattaaattcttacaaaacaaaatgtgttcgtttgttttatagtaagatgttttattttgaacttatttaaatgtttatttgttagagaaaactaatttgttaatatagatcttaactagtaactattaagcagggatgtttgttccaaatattcttgaataaacaatcaccacaaacaa

SEQ ID NO: 167603 - DNA, 3251 bp, Homo sapiens
  Payload ID: 12972
  Gene Symbol: POLR3G
  Gene Name: polymerase (RNA) III (DNA directed) polypeptide G (32kD)
  Uniprot ID: O15318
  ENST ID: ENST00000504930
  CDS Start-End: 166-837
aggtcggtgcgcgcttctcccgaggtggaacgggcggcagtcaagcgccggcgttctctgccgtcaccctttccttgccggccggcacttcggctgcagagttttgcccacgcttcgagacttagggagcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgatacagattataaaccagtgccactgaaaacaggagaaggtgaagaatatatgctggctttgaaacaggagttgagagaaacaatgaaaagaatgccttattttattgaaacacctgaagaaagacaagatattgaaaggtatagtaaaagatacatgaaggtatacaaggaagaatggataccagattggagaagacttccaagagagatgatgccaagaaataaatgtaaaaaagcaggcccaaaacccaaaaaggcaaaagacgcaggcaaaggcacaccactcactaatactgaagatgtgttgaaaaaaatggaggaattggaaaaaagaggtgatggtgaaaaatcagatgaggaaaatgaagagaaagaaggaagcaaagagaaaagtaaagaaggtgatgatgacgatgacgatgatgccgcagaacaggaggaatatgatgaagaagagcaagaagaggaaaatgactacattaattcatactttgaagatggagatgattttggcgcagacagtgatgacaacatggatgaggcaacctattaggcatgaaatttttcaaaaaatatttttatgatgcagcttctgaacatttggacagacttgatttgtattttatttctgataaggaataagtacttgtttctgttgttttggacaaatagttgttaccaaaatattcaaaaccactttgagtttacatactagttaccttaaaaattattccctgacactctgacattccttctaaacacctctgccatctctcttatgtactctcatgggtttttttgtatgatttgaatatgaatgtgcctaaagaatttttgctctcttaatctatgtatacatacttgaacaaatcattcttgcttaactgctgatcttttgtaaaactattgctagtcataatggatttctataacctgaaagttgatataatacagcacgtggagcactttaaaaacaaagaaacttgaaaataattttattttttacctttacatggtgtgttctagactactgcattatgactacataaacctacctgagctcttacaagtacagaattgtgagacagaggttttgtgatggaaaacatacacatagggaaaaataccaaactgagcaatataaatttcacagctcacatcttagccagtacaaagaaactttcacatggggtgaatattataatacttgaatttgagacttaatactgtatatgaattaatcatcccactgtaataactgacatcttcaaatagttgggcttatgaaaaatttgactaagacattttattttatactttatgtaaatgtgaaataagttctggtcatataaatatgtagaatgcatgtgtgtgaactctatgaagtgaagtgtggtggccttttatgtttcagagtactcaagtgtacaattgatttatataaaaatgcaaaatgaactcaggtcattttgaaattaatattaatatttttgttgtttaactttaaagctagctcccctaactttatatattttttgggaaaaaatacctaaaaacctcagcctacaaagactctcagaaatgccaaagattttcaaggaaattcatattatatatttcaaaaatgatttatcaatgttatctaccaaaagaaataattttatttttcccctttggggagatattatcctctaatatgagaatcagatccctagattctatttctacctatactattaaactcaaccttgaacctgagcttggttgtttctgtgccttagtttctccactcgtaaacaatttcctataaaaattgtttaaacaccaaccaaaatttaccatatgtattcattctcttgccttaaagatcacttcttaacttacatttggctctcaccctctaaaaatttgtagtttggagagtaactgaaagcacaattttaagaaacatgttttcctcacaaaatatattgtaatctgattttcctatcttgtattcatgcagaaaattggagaaaatgtgtattgtcttgtgccattctgcaatatgaatttctcaggaaaaagatgtttcaatggcaatactttcttaaataattcaagatgggtgtgaggacctatcttattagtttagtgctgtgttaaccatttgtgaattacttcttgtttaaaggaagttgtcaaaaaattttaagattctaaatggaatacacgaataaagtaagccttagaatagaaacctcacaaaaagttgtcatttgcggttgataattaacataggtgttttattctctcaactccttagtaccagagccaaatacaatttagttttcagaaatcttatcaatattgttctatttacctacttataaatctgcagataaccacttgaaccaggcaaatacactgaagataaaggttatttctttttttagctttgaatttgtcatgaccattttagtcttgcagatagcagggcagccccttggggcaaggatttactctgggaggtaccgttaagagccttctttccccctttgaaagatccttttacaatgttaaagtatactagttgcaagaacaagcaggatttgcaggttgctttaccagcatgagtctcatttttctggcttaaaatctgggactgtgaaattattccataggaaagtgaatgttattttgcagaattagcctcttacataaaagtatttgttgaagtgtctttaaaattgctatcatgagcaaaactggttgctgtaatgcttgtttttctgtatttatttacacattaaattcttacaaaacaaaatgtgttcgtttgttttatagtaagatgttttattttgaacttatttaaatgtttatttgttagagaaaactaatttgttaatatagatcttaactagtaactattaagcagggatgtttgttccaaatattcttgaataaacaatcaccacaaacaac

SEQ ID NO: 167604 - DNA, 583 bp, Homo sapiens
  Payload ID: 12972
  Gene Symbol: POLR3G
  Gene Name: polymerase (RNA) III (DNA directed) polypeptide G (32kD)
  ENST ID: ENST00000503973
  CDS Start-End: 201-583
actccgcggtcctggtgccgcgtgcaggtcggtgcgcgcttctcccgaggtggaacgggcggcagtcaagcgccggcgttctctgccgtcaccctttccttgccggccggcacttcggctgcagagttttgcccacgcttcgagacttagggagcagtgcctttcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgatacagattataaaccagtgccactgaaaacaggagaaggtgaagaatatatgctggctttgaaacaggagttgagagaaacaatgaaaagaatgccttattttattgaaacacctgaagaaagacaagatattgaaaggtatagtaaaagatacatgaaggtatacaaggaagaatggataccagattggagaagacttccaagagagatgatgccaagaaataaatgtaaaaaaggtacattgactaatataatagtaattca

SEQ ID NO: 167605 - DNA, 763 bp, Homo sapiens
  Payload ID: 12972
  Gene Symbol: POLR3G
  Gene Name: polymerase (RNA) III (DNA directed) polypeptide G (32kD)
  ENST ID: ENST00000503373
  CDS Start-End: 102-763
gacttgtgggcgtaccactcgagcgccgacatgctgggcaggggtgcagccaggcgggtgcctttcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgatacagattataaaccagtgccactgaaaacaggagaaggtgaagaatatatgctggctttgaaacaggagttgagagaaacaatgaaaagaatgccttattttattgaaacacctgaagaaagacaagatattgaaaggtatagtaaaagatacatgaaggtatacaaggaagaatggataccagattggagaagacttccaagagagatgatgccaagaaataaatgtaaaaaagcaggcccaaaacccaaaaaggcaaaagacgcaggcaaaggcacaccactcactaatactgaagatgtgttgaaaaaaatggaggaattggaaaaaagaggtgatggtgaaaaatcagatgaggaaaatgaagagaaagaaggaagcaaagagaaaagtaaagaaggtgatgatgacgatgacgatgatgccgcagaacaggaggaatatgatgaagaagagcaagaagaggaaaatgactacattaattcatactttgaagatggagatgattttggcgcagacagtgatgacaacatggatgaggc

SEQ ID NO: 167606 - DNA, 339 bp, Homo sapiens
  Payload ID: 12972
  Gene Symbol: POLR3G
  Gene Name: polymerase (RNA) III (DNA directed) polypeptide G (32kD)
  ENST ID: ENST00000512239
  CDS Start-End: 223-339
cacctggattatgttaacagcaagttagcaggccacatcattcagaagatacgggaaattaatattcttgagaagagaggaaattagacactacctgagagggtggggcatccagctcctaatgaaaaacaacttttgataacacggataacacagtactatcaccttcaaagtgtttgtgcctttcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcct

SEQ ID NO: 167607 - DNA, 682 bp, Homo sapiens
  Payload ID: 12972
  Gene Symbol: POLR3G
  Gene Name: polymerase (RNA) III (DNA directed) polypeptide G (32kD)
  ENST ID: ENST00000514483
  CDS Start-End: 170-472
gtgcgcgcttctcccgaggtggaacgggcggcagtcaagcgccggcgttctctgccgtcaccctttccttgccggccggcacttcggctgcagagttttgcccacgcttcgagacttagggagcagtgcctttcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgatacagattataaaccagtgccactgaaaacaggagaaggtgaagaatatatgctggctttgaaacaggagttgagagaaacaatgaaaagaatgccttattttattgaaacacctgaagaaagacaagagacgggagtcttgcttttttgctcacactggtctcacattcctggcttcaagtgatcctcccatctcggccttccaaagtgctgaaattacaggcatgagccaccgcacccagcttacctctgtttcctgatatagtgtttaaaaaacacacgcatgttaaaaataaaggtttttctataaaatatatacatttatatgtgcctatataggtttatataatatgtgtatatatgtgcatacataaatttatataatatccatgct

SEQ ID NO: 167608 - DNA, 581 bp, Homo sapiens
  Payload ID: 12972
  Gene Symbol: POLR3G
  Gene Name: polymerase (RNA) III (DNA directed) polypeptide G (32kD)
  ENST ID: ENST00000505345
  CDS Start-End: 304-581
aagcagtggccggcgcgccgcgtcctctttggcctctcggtcctgcaagaggccggaggagtacaggtactccgggaggctgcgcagccccaggcctgtatcgatcaccacgtcctgctcggagccgcgcaccagccagatgttggcacggttgcccgactcgtagaaacgttcttgaatccagaagataccatcgcctagagacttgtgggcgtaccactcgagcgccgacatgctgggcaggggtgcagccaggcgggtgcctttcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgatacagattataaaccagtgccactgaaaacaggagaaggtgaagaatatatgctggctttgaaacaggagttgagagaaacaatgaaaagaatgccttattttattgaaacacctgaagaaagacaagatattgaaaggtatagtaaaagatacatgaa

SEQ ID NO: 167609 - DNA, 995 bp, Homo sapiens
  Payload ID: 12972
  Gene Symbol: POLR3G
  Gene Name: polymerase (RNA) III (DNA directed) polypeptide G (32kD)
  ENST ID: ENST00000622335
  CDS Start-End: 156-857
cgaggtggaacgggcggcagtcaagcgccggcgttctctgccgtcaccctttccttgccggccggcacttcggctgcagagttttgcccacgcttcgagacttagggagcagtgcctttcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgatacagattataaaccagtgccactgaaaacaggagaaggtgaagaatatatgctggctttgaaacaggagttgagagaaacaatgaaaagaatgccttattttattgaaacacctgaagaaagacaagatattgaaaggtatagtaaaagatacatgaaggtatacaaggaagaatggataccagattggagaagacttccaagagagatgatgccaagaaataaatgtaaaaaagcaggcccaaaacccaaaaaggcaaaagacgcaggcaaaggcacaccactcactaatactgaagatgtgttgaaaaaaatggaggaattggaaaaaagaggtgatggtgaaaaatcagatgaggaaaatgaagagaaagaaggaagcaaagagaaaagtaaagaaggtgatgatgacgatgacgatgatgccgcagaacaggaggaatatgatgaagaagagcaagaagaggaaaatgactacattaattcatactttgaagatggagatgattttggcgcagacgtgatgacaacatggatgaggcaacctattaggcatgaaatttttcaaaaaatatttttatgatgcagcttctgaacatttggacagacttgatttgtattttatttctgataaggaataagtacttgtttctgttgttttggacaaatagttgttaccaaaatattcaaaaccactttgagtttacatactagttacctt

SEQ ID NO: 167610 - DNA, 818 bp, Homo sapiens
  Payload ID: 12973
  Gene Symbol: POLR3GL
  Gene Name: polymerase (RNA) III (DNA directed) polypeptide G (32kD)-like
  ENST ID: ENST00000369313
  CDS Start-End: 108-695
cttgaggaagcccagtacatttcaagttggtcgcggcttgggctccgctttggggaggggcagcaggtttattcactggatctctgaatacccaggccccctccaccatggccagccggggtgggggccggggtcgtggccggggccagttgaccttcaacgtggaggccgtgggcattgggaaaggggatgctttgcccccacccaccctgcagccttctccactcttccctcccttggagttccgcccagtacctttgccctcaggcgaggaaggggaatatgtcctggcactgaagcaagagctacgaggagccatgaggcagctcccctacttcatccggccagctgtccccaagagagattggcggcgtctaccccgggagctaaagatccgagtgcggaagctacagaaggaacggattacaattctgctccccaagaggccccctaagaccacagaagataaggaggaaacaatacagaaactagagaccctggagaagaaggaagaagaagtaacttcagaggaggatgaggagaaagaagaagaagaagagaaggaagaggaggaagaagaagagtatgatgaagaagaacatgaagaggaaactgattacatcatgtcatattttgacaatggagaggactttggtggtgacagtgatgacaatatggacgaggctatatactgaagaaggactctggaccctcgtgtctttctttaggatacagagagtaactgtacctattatttgtttcttcagacaagcaaatcatttggtcagagttcatataatctgtctgttccctggaga

SEQ ID NO: 167611 - DNA, 1165 bp, Homo sapiens
  Payload ID: 12973
  Gene Symbol: POLR3GL
  Gene Name: polymerase (RNA) III (DNA directed) polypeptide G (32kD)-like
  Uniprot ID: Q9BT43
  ENST ID: ENST00000369314
  CDS Start-End: 108-764
cttgaggaagcccagtacatttcaagttggtcgcggcttgggctccgctttggggaggggcagcaggtttattcactggatctctgaatacccaggccccctccaccatggccagccggggtgggggccggggtcgtggccggggccagttgaccttcaacgtggaggccgtgggcattgggaaaggggatgctttgcccccacccaccctgcagccttctccactcttccctcccttggagttccgcccagtacctttgccctcaggcgaggaaggggaatatgtcctggcactgaagcaagagctacgaggagccatgaggcagctcccctacttcatccggccagctgtccccaagagagatgtggagcgttattcagacaaatatcagatgtcaggtccgattgacaatgccatcgattggaaccctgattggcggcgtctaccccgggagctaaagatccgagtgcggaagctacagaaggaacggattacaattctgctccccaagaggccccctaagaccacagaagataaggaggaaacaatacagaaactagagaccctggagaagaaggaagaagaagtaacttcagaggaggatgaggagaaagaagaagaagaagagaaggaagaggaggaagaagaagagtatgatgaagaagaacatgaagaggaaactgattacatcatgtcatattttgacaatggagaggactttggtggtgacagtgatgacaatatggacgaggctatatactgaagaaggactctggaccctcgtgtctttctttaggatacagagagtaactgtacctattatttgtttcttcagacaagcaaatcatttggtcagagttcatataatctgtctgttccctggagatgggaatagaggatgatgacagtttattttctacacttcccctccttccacatttgtatcacctttgctatcttggggaaagtgcaaaggacaaacatctcaattgtatgaagggagaaaggagaattgaaagaagaactggggttgttagagctgagatgactgtacacatacccctgcccaatttatatagctctttgtggagataattaggggtgggagcagtttgaaggagtaagcctggttttatacttttaaataaagtgtttttatctgtc

SEQ ID NO: 167612 - DNA, 1330 bp, Homo sapiens
  Payload ID: 12974
  Gene Symbol: POLR3H
  Gene Name: polymerase (RNA) III (DNA directed) polypeptide H (22.9kD)
  Uniprot ID: Q9Y535
  ENST ID: ENST00000337566
  CDS Start-End: 362-889
aagcgcgagcggctgtgcgcggtgcgtggtgcgtggtgcgtgatacgagcggcggcacgtggcgcgggtgcggggcgtggagtggcgtggcgtggagtggcgtggcgtggcggggtctcgcggcgcgggcgcgcacccggagctgtggacggagagtgcctccctctggcctcagtttcctcatgttgtagtagcggagcatggcccggaccgggcccccgagaccgccccgtgcaacctcaccgccagcctgggggcctcagcgactgggacgggaccaaggggctcggggattctccctgcccccggccctggtgcgtgactgaccctcctgttcccagagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatcaaaaataaatacagttgcatgga

SEQ ID NO: 167613 - DNA, 4416 bp, Homo sapiens
  Payload ID: 12974
  Gene Symbol: POLR3H
  Gene Name: polymerase (RNA) III (DNA directed) polypeptide H (22.9kD)
  Uniprot ID: Q9Y535
  ENST ID: ENST00000355209
  CDS Start-End: 345-959
cgcggtgcgtggtgcgtggtgcgtgatacgagcggcggcacgtggcgcgggtgcggggcgtggagtggcgtggcgtggagtggcgtggcgtggcggggtctcgcggcgcgggcgcgcacccggagctgtggacggagagtgcctccctctggcctcagtttcctcatgttgtagtagcggagcatggcccggaccgggcccccgagaccgccccgtgcaacctcaccgccagcctgggggcctcagcgactgggacgggaccaaggggctcggggattctccctgcccccggccctggtgcgtgactgaccctcctgttcccagagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacgtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatcaaaaataaatacagttgcatggagctgcttaagatctgaaccaaactcaaaataggaagacgggggctaaaaagttattttaagaacccccccaccacaaccacagtcactccgtgggctaagcggggagcaggaagcatgtctggtcacaccatcttggaataggaagccatggctggacggatcggatccactgatggcacacgtggagctgaacttgacgccagcggcggggcggggaggcactgccctcactgttgcagttccttcattctgttgagggcactgccagcgcggaaccactcaatctgcgtctcgttgaaggtgtggttcaggaggatggtctcctgggtcccgttggggtgcttgatgatgcacttcaggggctgcaaggagaaggtgggtgtgggtggaagtggtgggtactgtgtgcccttggccccgcaggggggtcagggagacagggcactgcctggggacctaagaggtcagcaggcaaaccaaatcctaggccagtctgtgcctgatggcccaggtcagacccaggtggcacctacaggggattcctggggcccagagggtcctgcagtgggtgggctgtcccctgagtgccaggtcctggtgagtaaagggaggttggggaggtgtgagggccccgggttgactccaacccccaactctgagaagccactttgctttctctgtggggccacctggagaactgggggcctttccagctggaatgaagcctcctgggagaagctaccctggggccagtgcaggaggggaaacaaggtggctgcccctcaccccaccacctcagggggacccgggcccctaaccttgccaggggtgaagtccttcaggccctgaatggtcagcttgtccacagggtgaatcttgttgtagtcagccgggtcagcgaaggtcagaggcagcaggccctgtttcttcaggttggtctctggaaagcaggcggcattcggtcatcgggggcctgactagcctggagagcttcattttctgaacccatctggggctctgggagatgcccctaatcctgctgcctgggacaatgcccgggcagtgactatggggccctggtctgctccctttcactaggggtgcccctagcaagtgtgcgctggtgctgaggtctgcgaggccttcctgctgcacattcatgatcagaaagaaccccctggcacatgtcctagatctcagcggctcagatctacaagcctggaagcagggcctgcgggaagccgggaagctgagcgtcggatgtgcactgtgtgagcctaagaaggggcaagaggctgacgggcctgtgggctgcagtggacacagcctagaaccaggcccaactcagccacgggcagggagagtgaccttgatcactagggatgggatgaggatggcctgggtacagactccagctcaccgtggatcctggcaaagctcttggtgatgatggcccggcccccaaggtggcgaggctccagagctgcatgctcccggctcgagccctcgccgtagttctcgtctccgatcaccacccacctgatgccatgtttctgtcaggcaagcgggggtaaggttataaggcagaggagggcaccgtcctcacctgtctggccctacctgcctggcctcacccacctggcgcctgggcatcctgaggctcccggtaaaggggctggaggggcccttcctcgcctgctgcctaagggcaagtgaagcctgcgtgaatgagacccaaacgaggccccgaggggacagaggcacgtggttgtttgcagtggcaaagaagacagaagccacccattggtgcttggcagaggcaggtgtgtgtggagggaggttgggtgagacagggacggcctccgggccccacacaagatgcatctgtgaagctcaaggcgcccccttcctgggagcaccctctgccccacccagccaccagggggtgccagagtcctttcacccggctgggccaggacttgggttcagccctggttctgtttgtttctcaaagcagaaaaagtccaatcacctcagaccctctctgcctgctcactgtgaggccccgtgtagccccctctctgagcttttggcctctgacttcctgagtcggcccccttccttgtctttgtctagggccagatatcctaagatatctctcactaactcctcctggtgcagggacccggctgtaccaccggacctgggcctcatgccttctcagccacagggaggggctgcaggcctctcctcccttccacagcagtcccctttgggcttggtcggcctccttcccagtttccactcccctaatgtcctccctgcacctgccttgcaggccccttcaggagtgaccactggcattgcccctatcaactctgacccaccttgtagtagcgggcagtgtcagggacggggccaaactcctgagtgacggcattgcgcacggagttggccttgccgttttcaatgttgatggcaccaatgagcaggttgttggagatgttatccaagtgcccacggaacttgagccaggggccagcagctgagatgtggtcagtggtacacttccctttgaccttgggtggtaagtagagaggacagaggtcagggcatggccctggaggggtggatgacaagccctccagaggcaggcagcaggccccggggcccaggaggggtgacagaggggtgagaggcaggcaagtcttcagacacgtgttctgtggtcctggtgcttccaccctaaggccacatgggctcaggccaggccttcatcccctcaaaggcctctggctgctcagtctcccttatggggcagaggccgcccaaagttgggacaggtcaatgttcgctcacccttcaggcctcagctgcaagatcagccacagacctcatgctggacacaggagcccaggacatgcctgggtcctggctgatgactgattagtctcttctgtcacaggggtgcctggagaccccttaataagcagcataaataaatatctgacacag

SEQ ID NO: 167614 - DNA, 4176 bp, Homo sapiens
  Payload ID: 12974
  Gene Symbol: POLR3H
  Gene Name: polymerase (RNA) III (DNA directed) polypeptide H (22.9kD)
  Uniprot ID: Q9Y535
  ENST ID: ENST00000396504
  CDS Start-End: 83-697
gattcggaatctcgcccgcagtcgcgcaagcgcgagcggctgtgcgcggtgcgtggtgcgtgagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacgtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatcaaaaataaatacagttgcatggagctgcttaagatctgaaccaaactcaaaataggaagacgggggctaaaaagttattttaagaacccccccaccacaaccacagtcactccgtgggctaagcggggagcaggaagcatgtctggtcacaccatcttggaataggaagccatggctggacggatcggatccactgatggcacacgtggagctgaacttgacgccagcggcggggcggggaggcactgccctcactgttgcagttccttcattctgttgagggcactgccagcgcggaaccactcaatctgcgtctcgttgaaggtgtggttcaggaggatggtctcctgggtcccgttggggtgcttgatgatgcacttcaggggctgcaaggagaaggtgggtgtgggtggaagtggtgggtactgtgtgcccttggccccgcaggggggtcagggagacagggcactgcctggggacctaagaggtcagcaggcaaaccaaatcctaggccagtctgtgcctgatggcccaggtcagacccaggtggcacctacaggggattcctggggcccagagggtcctgcagtgggtgggctgtcccctgagtgccaggtcctggtgagtaaagggaggttggggaggtgtgagggccccgggttgactccaacccccaactctgagaagccactttgctttctctgtggggccacctggagaactgggggcctttccagctggaatgaagcctcctgggagaagctaccctggggccagtgcaggaggggaaacaaggtggctgcccctcaccccaccacctcagggggacccgggcccctaaccttgccaggggtgaagtccttcaggccctgaatggtcagcttgtccacagggtgaatcttgttgtagtcagccgggtcagcgaaggtcagaggcagcaggccctgtttcttcaggttggtctctggaaagcaggcggcattcggtcatcgggggcctgactagcctggagagcttcattttctgaacccatctggggctctgggagatgcccctaatcctgctgcctgggacaatgcccgggcagtgactatggggccctggtctgctccctttcactaggggtgcccctagcaagtgtgcgctggtgctgaggtctgcgaggccttcctgctgcacattcatgatcagaaagaaccccctggcacatgtcctagatctcagcggctcagatctacaagcctggaagcagggcctgcgggaagccgggaagctgagcgtcggatgtgcactgtgtgagcctaagaaggggcaagaggctgacgggcctgtgggctgcagtggacacagcctagaaccaggcccaactcagccacgggcagggagagtgaccttgatcactagggatgggatgaggatggcctgggtacagactccagctcaccgtggatcctggcaaagctcttggtgatgatggcccggcccccaaggtggcgaggctccagagctgcatgctcccggctcgagccctcgccgtagttctcgtctccgatcaccacccacctgatgccatgtttctgtcaggcaagcgggggtaaggttataaggcagaggagggcaccgtcctcacctgtctggccctacctgcctggcctcacccacctggcgcctgggcatcctgaggctcccggtaaaggggctggaggggcccttcctcgcctgctgcctaagggcaagtgaagcctgcgtgaatgagacccaaacgaggccccgaggggacagaggcacgtggttgtttgcagtggcaaagaagacagaagccacccattggtgcttggcagaggcaggtgtgtgtggagggaggttgggtgagacagggacggcctccgggccccacacaagatgcatctgtgaagctcaaggcgcccccttcctgggagcaccctctgccccacccagccaccagggggtgccagagtcctttcacccggctgggccaggacttgggttcagccctggttctgtttgtttctcaaagcagaaaaagtccaatcacctcagaccctctctgcctgctcactgtgaggccccgtgtagccccctctctgagcttttggcctctgacttcctgagtcggcccccttccttgtctttgtctagggccagatatcctaagatatctctcactaactcctcctggtgcagggacccggctgtaccaccggacctgggcctcatgccttctcagccacagggaggggctgcaggcctctcctcccttccacagcagtcccctttgggcttggtcggcctccttcccagtttccactcccctaatgtcctccctgcacctgccttgcaggccccttcaggagtgaccactggcattgcccctatcaactctgacccaccttgtagtagcgggcagtgtcagggacggggccaaactcctgagtgacggcattgcgcacggagttggccttgccgttttcaatgttgatggcaccaatgagcaggttgttggagatgttatccaagtgcccacggaacttgagccaggggccagcagctgagatgtggtcagtggtacacttccctttgaccttgggtggtaagtagagaggacagaggtcagggcatggccctggaggggtggatgacaagccctccagaggcaggcagcaggccccggggcccaggaggggtgacagaggggtgagaggcaggcaagtcttcagacacgtgttctgtggtcctggtgcttccaccctaaggccacatgggctcaggccaggccttcatcccctcaaaggcctctggctgctcagtctcccttatggggcagaggccgcccaaagttgggacaggtcaatgttcgctcacccttcaggcctcagctgcaagatcagccacagacctcatgctggacacaggagcccaggacatgcctgggtcctggctgatgactgattagtctcttctgtcacaggggtgcctggagaccccttaataagcagcataaataaatatctgacacagattggaggcctctggccacacc

SEQ ID NO: 167615 - DNA, 802 bp, Homo sapiens
  Payload ID: 12974
  Gene Symbol: POLR3H
  Gene Name: polymerase (RNA) III (DNA directed) polypeptide H (22.9kD)
  Uniprot ID: Q9Y535
  ENST ID: ENST00000407461
  CDS Start-End: 117-731
ctctcctcgccctctctctgccccacgctgtgcgcgagcacacaggcagccccgccccgcctcggcggggtgggggtggacagaggtttcttattgagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacgtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcag

SEQ ID NO: 167616 - DNA, 1464 bp, Homo sapiens
  Payload ID: 12974
  Gene Symbol: POLR3H
  Gene Name: polymerase (RNA) III (DNA directed) polypeptide H (22.9kD)
  ENST ID: ENST00000431534
  CDS Start-End: 355-726
agcggctgtgcgcggtgcgtggtgcgtggtgcgtgatacgagcggcggcacgtggcgcgggtgcggggcgtggagtggcgtggcgtggagtggcgtggcgtggcggggtctcgcggcgcgggcgcgcacccggagctgtggacggagagtgcctccctctggcctcagtttcctcatgttgtagtagcggagcatggcccggaccgggcccccgagaccgccccgtgcaacctcaccgccagcctgggggcctcagcgactgggacgggaccaaggggctcggggattctccctgcccccggccctggtgcgtgactgaccctcctgttcccagagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacggtaacagtggccctgacgcctcagacaagacttgggaacactgtgggggcaggagtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatcaaaaataaatacagttgcatgg

SEQ ID NO: 167617 - DNA, 553 bp, Homo sapiens
  Payload ID: 12974
  Gene Symbol: POLR3H
  Gene Name: polymerase (RNA) III (DNA directed) polypeptide H (22.9kD)
  ENST ID: ENST00000442616
  CDS Start-End: 54-266
gcgcgagcggctgtgcgcggtgcgtggtgcgtgagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagggtgagaggtccatcggctgcctctcctcatgccctgctgatgccagggtccctgccgtcctggggggcatgttggccgactaaatggttgacggcatcgtggaagcctgtgtttgggattaaacctgtctgaggaaggcaagattcgacccggtggccctgtctgtccattttcgctgcgtggtgtttcatccattcctagatgagattctcattgggaagatcaaaggctgcagcccagaaggagtgcacgtctctctaggcttcttcgatgacattctcatccccccag

SEQ ID NO: 167618 - DNA, 1598 bp, Homo sapiens
  Payload ID: 12974
  Gene Symbol: POLR3H
  Gene Name: polymerase (RNA) III (DNA directed) polypeptide H (22.9kD)
  ENST ID: ENST00000432789
  CDS Start-End: 327-809
gtgcgtgatacgagcggcggcacgtggcgcgggtgcggggcgtggagtggcgtggcgtggagtggcgtggcgtggcggggtctcgcggcgcgggcgcgcacccggagctgtggacggagagtgcctccctctggcctcagtttcctcatgttgtagtagcggagcatggcccggaccgggcccccgagaccgccccgtgcaacctcaccgccagcctgggggcctcagcgactgggacgggaccaaggggctcggggattctccctgcccccggccctggtgcgtgactgaccctcctgttcccagagcccccagcgcaggccgggatgttcgtcctggtggaaatggtggacaccgtccggatccccccttggcagtttgagaggaagctcaacgactccattgccgaggagctgaacaagaagttggccaacaaggtactgggcccacggctcgcgggcaggccttggcgtgggagagcgagcgccgcccactggccgcaggcccggcctcggtcatgccaagccctggccgtgggcaagcagcttaatgtctcagaacttttcttcaccgtgaaaggagatattgaaggggatcaaaagaaaatgggcttgaaaaagggagttgtaactggaagtgttagattccacaattctaaattactttgcaattgcaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacgtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatc

SEQ ID NO: 167619 - DNA, 1392 bp, Homo sapiens
  Payload ID: 12975
  Gene Symbol: POLR3K
  Gene Name: polymerase (RNA) III (DNA directed) polypeptide K, 12.3 kDa
  Uniprot ID: Q9Y2Y1
  ENST ID: ENST00000293860
  CDS Start-End: 43-369
agtgggagctgccgggagttggagcctgcggagttcgagaccatgctgctgttctgccccggctgcgggaacgggctgatcgtggaggagggacaacgctgccaccgcttcgcctgcaacacgtgcccctacgtgcacaacatcacccgcaaggtaacaaatcggaagtacccaaaactgaaagaagtggatgatgtgcttggtggagcagctgcctgggagaatgttgactctactgcagagtcgtgtcccaaatgcgaacatcctcgtgcttacttcatgcagcttcagacccgctctgcagatgagccgatgaccaccttctacaagtgctgcaatgctcagtgtggacaccgctggagggattagggccaggatggcccagctgccctagtgtgtgcttgccttgtccctcggggtagatgcttagctggcagtatgagttgtgtgtcctgagggtctttgctagtgtggtggaaagataaaccttttgaggtgaagagccagggggtcaggaaatatggcctatctgccaggcagggtggatgaagtcatgaatgtctgggagtttttctgtgtggggaggagacagagacccataactaaatatgctctgtgtaaagtcctattctttcatcttccactttattggcagttgacattcccttactcccaatcaacactcttaaatatttgtactgtttgtaaaacttagtacatgtccctaaatatttaactgttacttgtaaacttgtgtaatttattatttattttaatcaaaattctgaatatttcatttaaatgaaagttggaatattgccttctcagtgttttaaatagcttaagaggtagaaagcaaaccccaaatcacagtgatcccagaatagactacatacttacatttgaacaggctacgaaaatgttaatcaccgggatttcaatttctttctttattcctattcttactcccttattcatttttttgaacctcccctgatttgcttcctcgggttgctttaaatgtataagatactatttatttatttatttattttatttatttatttatttatttaagacagagtcttgttctgtcgcccaggctggagtgcagtggtacgaattcagctcactgcaacctctgccttccgggttcaagggattctcctgtctcagcctcccaagcagctgggactacaggcatgcaccaccacacctgggtaattttgcatttttagtagagatggggtttctccatgttggtcgggctggtctccaactcctgacctcagataatctgtctgcctcggcctcctaaagtgctgggattacaggcgtgagccactgtgtcccaccaatctttacatttaatatgactattttcttattgtt

SEQ ID NO: 167620 - DNA, 3835 bp, Homo sapiens
  Payload ID: 12976
  Gene Symbol: POLRMT
  Gene Name: polymerase (RNA) mitochondrial (DNA directed)
  Uniprot ID: O00411
  ENST ID: ENST00000588649
  CDS Start-End: 93-3785
cctccgtcgaccatgaaaccacaactcccggcaggcggcgcgggcgcatgcgcaggcgcgggccggtggggtggcctggagcggcgtgcgtaatgtcggcactttgctggggccgcggagcggcggggctcaaacgagccctacggccttgcggccgcccgggactccccggcaaagaagggaccgccggtggcgtctgcggccccaggaggagctcgtccgccagcccccaggagcaagaccaagaccgcaggaaggactggggccacgtggagctgctggaggtgctccaggcgcgggtgcggcagctgcaggctgagagcgtgtcggaggtggtggtgaacagggtggatgtggcgcggctcccagaatgtggcagtggagatggtagcctccagccacccaggaaggtccagatgggggccaaggatgccaccccggtgccctgtggccgctgggcaaagatactggagaaggataagcggacccagcagatgcgtatgcagcggttgaaggcgaagctgcagatgccattccagagcggggagttcaaggcgctgaccaggcgcctgcaggtggagccccggctcctgagcaagcagatggccgggtgcctggaggactgcacgcgccaggcccccgagagcccctgggaggagcagctggcccggctgctgcaggaggcccctgggaagctgagcctcgatgtggagcaggccccgtcggggcagcactcgcaggcccagctctcaggtcagcagcagaggctcctggccttcttcaagtgctgcctgctcactgaccagctgcccctcgcccaccacctgctggtcgtccaccacggccagcggcagaagcggaagctgctcacgctggacatgtacaacgccgtgatgcttggctgggcgcggcagggtgccttcaaggagctggtatatgtgttattcatggtgaaggatgccggcttgactccggacctgctgtcctatgcggctgccctccagtgcatggggaggcaggaccaggacgccgggaccatcgaaaggtgtctggaacagatgagccaggaggggctgaagctgcaggcactcttcaccgccgttctgctgtctgaggaggatcgggccactgttctgaaggccgtgcacaaggtgaagcccaccttcagcctcccgccgcagctgccgcccccggtcaacacctccaagctgctcagggacgtgtatgccaaggatgggcgtgtgtcctacccgaagctgcacctgcccttgaagaccctgcagtgcctctttgagaagcagctccacatggagctggccagcagggtgtgcgtggtgtccgtggagaagcccacgttgccaagcaaggaggtcaagcacgcgcggaagaccctgaagaccctgcgggaccaatgggagaaagcactgtgccgggcgctgcgggagaccaagaaccgcctagagcgcgaggtgtacgagggccggttctcactttaccccttcctgtgcctgctggacgagcgcgaggtggtgcggatgctcctgcaggtcctgcaggcgctgcccgcccaaggtgagtccttcaccaccctggcccgggagctgagtgcgcgcactttcagccggcacgtggtgcagaggcagcgggtcagtggccaggtgcaggcgctgcagaaccactacaggaagtacctctgcttgctggcctccgacgccgaggtgcccgagccctgcctgccgcggcagtactgggaggagctgggggcgcccgaggccctgcgggagcagccctggcccctgccagtgcagatggagctgggcaagctgctggcggagatgctggtgcaggctacgcagatgccatgcagcctggacaagccgcatcgttcctctcggcttgtccccgtgctctaccacgtgtattccttccgcaacgtccagcagatcggcatcctgaagccgcacccggcctacgtgcagctgctggagaaggccgcggagcccacgctgaccttcgaggcggtggatgtacccatgctttgccccccgctgccctggacatcgccgcactctggtgctttcctgctcagccccaccaagctgatgcgcacggtggaaggcgccacgcagcaccaggagctgctggaaacctgcccgcccaccgcgctgcatggcgcactggacgccctcacccaactgggcaactgcgcctggcgcgtcaacgggcgcgtgctggacctggtgctgcagctcttccaggccaagggctgcccccagctaggcgtgccggccccgccctccgaggcgccccagccgcccgaggcccacctgccgcacagcgccgcgcccgcccgcaaggccgagctgcgccgtgagctggcgcactgccagaaggtggcccgggagatgcacagcctgcgggcggaggcgctgtaccgcctctcgctggcgcagcacctgcgggaccgcgtcttctggctgccgcacaacatggacttccgcggccgcacctacccctgcccgccgcacttcaaccacctgggcagcgacgtggcgcgggccctgctggagttcgcccagggccgcccgctcggcccgcacggcctggattggctcaagatccacctggtcaatctcacggggttgaagaagcgggagccgctgcggaagcgcctggcctttgcggaggaggtgatggatgacatcctggactccgcggaccaacccttgacgggccgaaagtggtggatgggcgcggaggaaccctggcagacgctggcctgctgtatggaggtggcgaacgctgtgcgcgcctccgaccctgccgcctatgtctcccacctccccgtccatcaggacggctcttgcaacggcctgcagcattatgctgctctgggccgcgacagcgtgggcgccgcctccgtcaacctggagccctcggatgtgccgcaggacgtgtacagcggcgtggccgcgcaggtggaggtgttccgtaggcaggacgcccagcggggcatgcgggtggcacaggtgctggaaggtttcatcacccgcaaggtggtgaagcagacggtgatgacggtggtgtacggggtcacgcgctatggcgggcgcctgcagattgagaagcgcctccgggagctgagcgactttccccaggagttcgtgtgggaggcctctcactatctcgtacgccaggtcttcaagagtctacaggagatgttctcggggacccgggccatccagcactggctgaccgagagtgcccgcctcatctcccacatgggctctgtggtggagtgggtcacacccctgggcgtccccgtcatccagccctatcgcctggactccaaggtcaagcaaataggaggtggaattcagagcatcacctacacccacaacggagacatcagccgaaagcccaacacacgtaagcagaagaacggcttcccgcccaacttcatccactcgctggactcctcccacatgatgctcaccgccctgcactgctacaggaagggcctgaccttcgtctctgtgcacgactgttactggactcacgcagctgatgtctccgtcatgaaccaggtgtgccgggagcagtttgtccgcttgcacagcgagcccatcctgcaggacctgtccagattcctggtcaagcggttctgctctgagccccagaagatcttggaggccagccagctgaaggagacactgcaggcggtgcccaagccaggggccttcgacctggagcaggtgaagcgttccacctacttcttcagctgacaccccgtgagccttgtcagtgtgtaaataaagctcttttgccaccccca

SEQ ID NO: 167621 - DNA, 1043 bp, Homo sapiens
  Payload ID: 12976
  Gene Symbol: POLRMT
  Gene Name: polymerase (RNA) mitochondrial (DNA directed)
  ENST ID: ENST00000590573
  CDS Start-End: 1-1043
gtgctccaggcgcgggtgcggcagctgcaggctgagagcgtgtcggaggtggtggtgaacagggtggatgtggcgcggctcccagaatgtggcagtggagatggtagcctccagccacccaggaaggtccagatgggggccaaggatgccaccccggtgccctgtggccgctgggcaaagatactggagaaggataagcggacccagcagatgcgtatgcagcggttgaaggcgaagctgcagatgccattccagagcggggagttcaaggcgctgaccaggcgcctgcaggtggagccccggctcctgagcaagcagatggccgggtgcctggaggactgcacgcgccaggcccccgagagcccctgggaggagcagctggcccggctgctgcaggaggcccctgggaagctgagcctcgatgtggagcaggccccgtcggggcagcactcgcaggcccagctctcaggtcagcagcagaggctcctggccttcttcaagtgctgcctgctcactgaccagctgcccctcgcccaccacctgctggtcgtccaccacggccagcggcagaagcggaagctgctcacgctggacatgtacaacgccgtgatgcttggctgggcgcggcaggatgccggcttgactccggacctgctgtcctatgcggctgccctccagtgcatggggaggcaggaccaggacgccgggaccatcgaaaggtgtctggaacagatgagccaggaggggctgaagctgcaggcactcttcaccgccgttctgctgtctgaggaggatcgggccactgttctgaaggccgtgcacaaggtgaagcccaccttcagcctcccgccgcagctgccgcccccggtcaacacctccaagctgctcagggacgtgtatgccaaggatgggcgtgtgtcctacccgaagctgcacctgcccttgaagaccctgcagtgcctctttgagaagcagctccacatggagctggccagcagggtgtgcgtggtgtccgtggagaagcccacgttgccaagcaagga

SEQ ID NO: 167622 - DNA, 380 bp, Homo sapiens
  Payload ID: 12976
  Gene Symbol: POLRMT
  Gene Name: polymerase (RNA) mitochondrial (DNA directed)
  ENST ID: ENST00000590336
  CDS Start-End: 1-380
gcctggactccaaggtcaagcaaataggaggtggaattcagagcatcacctacacccacaacggagacatcagccgcccaacacacgtaagcagaagaacggcttcccgcccaacttcatccactcgctggactcctcccacatgatgctcaccgccctgcactgctacaggaagggcctgaccttcgtctctgtgcacgactgttactggactcacgcagctgatgtctccgtcatgaaccaggtgtgccgggagcagtttgtccgcttgcacagcgagcccatcctgcaggacctgtccagattcctggtcaagcggttctgctctgagccccagaagatcttggaggccagccagctgaaggagacactgcaggcgg

SEQ ID NO: 167623 - DNA, 966 bp, Homo sapiens
  Payload ID: 12976
  Gene Symbol: POLRMT
  Gene Name: polymerase (RNA) mitochondrial (DNA directed)
  ENST ID: ENST00000592863
  CDS Start-End: 14-184
agcggcgtgcgtaatgtcggcactttgctggggccgcggagcggcggggctcaaacgagccctacggccttgcggccgcccgggactccccggcaaagaaggtaacacaaagggagacggccaggcagcccgggggccacggcgtgggctcctccccgcgcggccggggcctttggcgctttgacctttgcctctttgcacctgggcgtgcgcagcccaccgacccggccccgctttccactcgcccttgcccgcttttcgactgaggctcctccgtgcagtctgacctttgactcgtggtttcttatgcagcctcctgaccccaggtggaccgccggtggcgtctgcggccccaggaggagctcgtccgccagcccccaggagcaagaccaagaccgcaggaaggactggggccacgtggagctgctggaggtgctccaggcgcgggtgcggcagctgcaggctgagagcgtgtcggaggtggtggtgaacagggtggatgtggcgcggctcccagaatgtggcagtggagatggtagcctccagccacccaggaaggtccagatgggggccaaggatgccaccccggtgccctgtggccgctgggcaaagatactggagaaggataagcggacccagcagatgcgtatgcagcggttgaaggcgaagctgcagatgccattccagagcggggagttcaaggcgctgaccaggcgcctgcaggtggagccccggctcctgagcaagcagatggccgggtgcctggaggactgcacgcgccaggcccccgagagcccctgggaggagcagctggcccggctgctgcaggaggcccctgggaagctgagcctcgatgtggagcaggccccgtcggggcagcactcgcaggcccagctctcaggtcagcagcagaggctcctggccttcttcaagtgctgcctgctcactgaccagctgcccctcgcc

SEQ ID NO: 167624 - DNA, 3828 bp, Homo sapiens
  Payload ID: 12977
  Gene Symbol: PTRF
  Gene Name: polymerase I and transcript release factor
  Uniprot ID: Q6NZI2
  ENST ID: ENST00000357037
  CDS Start-End: 421-1593
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctgccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacaacccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccctgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttatgcctgtaaccccagcactttgggaggccgaggtgggcggatcacctgaagtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgatacgctgtttaaaaaggaaaaaatccttccctagagctagtatcctaaagctgcagagctagcccagacctcattggtttccttgtccttggggtgcttttcctgaatctttgcgggtgaagggagtgttgctcccagtccagaggcctgattctgtttggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaa

SEQ ID NO: 167625 - DNA, 4279 bp, Homo sapiens
  Payload ID: 12978
  Gene Symbol: PIGR
  Gene Name: polymeric immunoglobulin receptor
  Uniprot ID: P01833
  ENST ID: ENST00000356495
  CDS Start-End: 185-2479
gagcagagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtaaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaggctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttttgtagagacagggtttcgccatgttgacgagactggtctcgaactcctggcctcaagtgatctgccgcctcagcttctcaaagtactgggattatataggcatgagccactgagcctggccctgaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccaccaacgag

SEQ ID NO: 167626 - DNA, 2041 bp, Homo sapiens
  Payload ID: 12979
  Gene Symbol: PNKP
  Gene Name: polynucleotide kinase 3'-phosphatase
  Uniprot ID: Q96T60
  ENST ID: ENST00000322344
  CDS Start-End: 432-1997
tagaacatcgagggtgaagccaaagaaggacttaggggcgctgtcgggggcggaggtttcctcgactgacaatgaccatcagatgggaaaaaaatcttcctccctgggatgaaaattagaagtcaaggtggaaagaggcaaatctgctaacggaggatccagtccccgctaccggcctgagcctcgcgttgcagcaagagagatgaaggtcagggctgccgagagaccctgggggccgggagtcggggaaggggcgtggctgctgtgggaggaggccaggccccgccccccacccacgaggggacgagtcatttccgtccgccgaggaaccgaccgccgccggccgggttgcaggcggggcacctcgggcaggacctccctggtcggaagtggccgtgagcccaagccgcggtcccgggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 167627 - DNA, 1723 bp, Homo sapiens
  Payload ID: 12979
  Gene Symbol: PNKP
  Gene Name: polynucleotide kinase 3'-phosphatase
  ENST ID: ENST00000593946
  CDS Start-End: 31-186
gtttacctgctccccaggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagcctgaagcaggccacactccccagaaatgagggacccaatcacacaaggatgcaaatcctgactccacccctccaatcctcagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 167628 - DNA, 1602 bp, Homo sapiens
  Payload ID: 12979
  Gene Symbol: PNKP
  Gene Name: polynucleotide kinase 3'-phosphatase
  ENST ID: ENST00000600573
  CDS Start-End: 122-1594
atttccgtccgccgaggaaccgaccgccgccggccgggttgcaggcggggcacctcgggcaggacctccctggtcggaagtggccgtgagcccaagccgcggtcccgggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcc

SEQ ID NO: 167629 - DNA, 986 bp, Homo sapiens
  Payload ID: 12979
  Gene Symbol: PNKP
  Gene Name: polynucleotide kinase 3'-phosphatase
  ENST ID: ENST00000599543
  CDS Start-End: 245-986
atcctttttatagatgaggaaactagaacatcgagggtgaagccaaagaaggacttaggggcgctgtcgggggcggaggtttcctcgactgacaatgaccatcagatgggaaaaaaatcttcctccctgggatgaaaattagaagtcaaggtggaaagaggcaaatctgctaacggaggatccagtccccgctaccggcctgagcctcgcgttgcagcaagagagatgaaggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttcc

SEQ ID NO: 167630 - DNA, 534 bp, Homo sapiens
  Payload ID: 12979
  Gene Symbol: PNKP
  Gene Name: polynucleotide kinase 3'-phosphatase
  ENST ID: ENST00000598020
  CDS Start-End: 79-234
ggcggggcacctcgggcaggacctccctggtcggaagtggccgtgagcccaagccgcggtcccgggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagcctgaagcaggccacactccccagaaatgagggacccaatcacacaaggatgcaaatcctgactccacccctccaatcctcagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctgg

SEQ ID NO: 167631 - DNA, 637 bp, Homo sapiens
  Payload ID: 12979
  Gene Symbol: PNKP
  Gene Name: polynucleotide kinase 3'-phosphatase
  ENST ID: ENST00000596726
  CDS Start-End: 108-637
aggggacgagtcatttccgtccgccgaggaaccgaccgccgccggccgggttgcaggcggggcacctcgggcaggacctccctggtcggaagtggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcat

SEQ ID NO: 167632 - DNA, 351 bp, Homo sapiens
  Payload ID: 12979
  Gene Symbol: PNKP
  Gene Name: polynucleotide kinase 3'-phosphatase
  ENST ID: ENST00000597965
  CDS Start-End: 1-171
gccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggtactgttggggatagcagggggcaggggcactggctgggccacatgatccaggctgtccctcactgttcccaccactgccaggaagcagttcgaggccccaacgctggctgaaggcttctctgccatcctggagatcccgttccggctatgggtggagccgaggctggggcggctgtactgccagttctccgagg

SEQ ID NO: 167633 - DNA, 1665 bp, Homo sapiens
  Payload ID: 12979
  Gene Symbol: PNKP
  Gene Name: polynucleotide kinase 3'-phosphatase
  Uniprot ID: Q96T60
  ENST ID: ENST00000596014
  CDS Start-End: 83-1648
ggaggaggcgggacttcctgcagcaaattggggctgtgcgccgctcaagcccgtttacctgctccccaggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccc

SEQ ID NO: 167634 - DNA, 1600 bp, Homo sapiens
  Payload ID: 12979
  Gene Symbol: PNKP
  Gene Name: polynucleotide kinase 3'-phosphatase
  ENST ID: ENST00000600910
  CDS Start-End: 101-1468
gaccgccgccggccgggttgcaggcggggcacctcgggcaggacctccctggtcggaagtggccgtgagcccaagccgcggtcccgggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 167635 - DNA, 1530 bp, Homo sapiens
  Payload ID: 12979
  Gene Symbol: PNKP
  Gene Name: polynucleotide kinase 3'-phosphatase
  ENST ID: ENST00000627232
  CDS Start-End: 1-525
atgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttga

SEQ ID NO: 167636 - DNA, 767 bp, Homo sapiens
  Payload ID: 12979
  Gene Symbol: PNKP
  Gene Name: polynucleotide kinase 3'-phosphatase
  ENST ID: ENST00000627317
  CDS Start-End: 1-767
cggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctc

SEQ ID NO: 167637 - DNA, 1545 bp, Homo sapiens
  Payload ID: 12979
  Gene Symbol: PNKP
  Gene Name: polynucleotide kinase 3'-phosphatase
  ENST ID: ENST00000631020
  CDS Start-End: 55-1512
tggggctgtgcgccgctcaagcccgtttacctgctccccaggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctg

SEQ ID NO: 167638 - DNA, 629 bp, Homo sapiens
  Payload ID: 12979
  Gene Symbol: PNKP
  Gene Name: polynucleotide kinase 3'-phosphatase
  ENST ID: ENST00000625216
  CDS Start-End: 1-264
gacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgc

SEQ ID NO: 167639 - DNA, 3847 bp, Homo sapiens
  Payload ID: 12980
  Gene Symbol: GALNT1
  Gene Name: polypeptide N-acetylgalactosaminyltransferase 1
  Uniprot ID: Q10472
  ENST ID: ENST00000269195
  CDS Start-End: 104-1783
ggtatgaacgtgatttctgatgaaactggattggaataattttcatgatctttgtatatttatatatatatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggtgttacaaaggtagattatggagatatatcgtcaagagttggtctaagacacaaactacaatgcaaacctttttcctggtacctagagaatatatatcctgattctcaaattccacgtcactatttctcattgggagagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaattggcattttttaatgacttagccaaagaagtgcagctattattccatattaataggcttgcatttcttttcctaaatcttatttaggctaaatcagttttatttttctctgattttttttaataccacagaatcacctgagtgtcaattgaaagttgtcaattaaaaggtaaccttttaatctcgtaggaggaatctcattaagacatttttcctgatatgtagagcagtctgttggcaaaaatgcatatattttctttcatatttgtaaaattatatttaatggaattcttttctttgattatcaaggactttcactgcaggcagtgctatttcttgtgcctaagaatgtttccaaaagtcgcatcgctaatgatatttgccaagttgagtgtacacaaagtttctcatatcctgttcaagttaatcaacatcaagcacatggggatgctttagggtgagtctatagtacaaaatgcataaaccatgtccccaggaaatttgaaaggaagcaggtgctgaatggaatttttttccttttccatgagctgtgttaattctatctccagtaggcctaatgcttgaataagcaagatgtctaatcaataaattattttcatgctcagaatttcaggtttttgtactccagcatagcttggtcttatttcttactgtatgaaagcttaacagcaatgtgatttaaggttttgttttaaatgggagatgtaagtgatttaattcatgggtacttttagaacctgatagataatcccattgcctttatttttctaattaaagaattcctaaatactttgaaaatacaaaatattcctgaata

SEQ ID NO: 167640 - DNA, 2346 bp, Homo sapiens
  Payload ID: 12980
  Gene Symbol: GALNT1
  Gene Name: polypeptide N-acetylgalactosaminyltransferase 1
  ENST ID: ENST00000589189
  CDS Start-End: 160-1323
aggagatgtgggacatgtggatttgggatatgaattcatttgaaaaaccactttggggtatgaacgtgatttctgatgaaactggattggaataattttcatgatctttgtatatttatatatatatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggttagcgttgttttgcattagaaatacaaggcttttaggttgatatttagtgtatatgtgtgtgtatctgtctgtctaattaacttctccaactcctgatattttcattatttattgtcccatagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagg

SEQ ID NO: 167641 - DNA, 1770 bp, Homo sapiens
  Payload ID: 12980
  Gene Symbol: GALNT1
  Gene Name: polypeptide N-acetylgalactosaminyltransferase 1
  ENST ID: ENST00000590654
  CDS Start-End: 8-160
aagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgcgcaggtaaattgaacatgaaattggaaattgacaaggatgttgaagtagcagaaagttaccagtgagttaagttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggtgttacaaaggtagattatggagatatatcgtcaagagttggtctaagacacaaactacaatgcaaacctttttcctggtacctagagaatatatatcctgattctcaaattccacgtcactatttctcattgggagagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaattt

SEQ ID NO: 167642 - DNA, 542 bp, Homo sapiens
  Payload ID: 12980
  Gene Symbol: GALNT1
  Gene Name: polypeptide N-acetylgalactosaminyltransferase 1
  Uniprot ID: Q10472
  ENST ID: ENST00000591924
  CDS Start-End: 227-542
agtggccgaggagcgcgcggcggacggcggcccgagagtagcgcgctggccgcgggaccggccgcgaccgccgcggccggcccggaggacgcctgccgccgccgccgccgcgcgcctagcgagggtatgaacgtgatttctgatgaaactggattggaataattttcatgatctttgtatatttatatatatatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggt

SEQ ID NO: 167643 - DNA, 1120 bp, Homo sapiens
  Payload ID: 12980
  Gene Symbol: GALNT1
  Gene Name: polypeptide N-acetylgalactosaminyltransferase 1
  Uniprot ID: Q10472
  ENST ID: ENST00000591081
  CDS Start-End: 92-409
atttctgatgaaactggattggaataattttcatgatctttgtatatttatatatatatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtaagtacttactgtggtcctgatagtatgtgaatgaaaagtatattctgaattttcagtaaattgcacttgagtgctgattgttcttaaggcaaatgttatatcactatgttactacttaccccacttagaaaataattaaatgctgatagaaataatatctcaagcttctactgattattagcactatgtatttcaggcattggaagataattatttatcttaatggattagaaggggattttaaactttattattaccaaaatactcacatactcaactttttacaaaaagatttaagttgtatgtaacttgaaacagtgaaatacacagtcgtaagtatacagctcactgaattttttgctatgtatacacctgtgtaaccatcagccaaatcaagacatagaatgatcccatcacccctgaaagtctccttatgttttttgtagtcattacttacatccccagaggcagccgttatattgacctctctaaacatagattagttttgtctctttttgaactttttatgatggatccacaccattttttgtgcctttaagattcatattgttgcatgtatcagaattttattcttttctactgcaaatagtgatttgtaatatgaatatgccattgtttatttatacattgatagacctttggattatttctactttttgacccctataaataaagctattgtgacattctt

SEQ ID NO: 167644 - DNA, 5961 bp, Homo sapiens
  Payload ID: 12981
  Gene Symbol: GALNT10
  Gene Name: polypeptide N-acetylgalactosaminyltransferase 10
  Uniprot ID: Q86SR1
  ENST ID: ENST00000297107
  CDS Start-End: 138-1949
gcggagttggagcggggccggcgccgcagccgcttctgctggctgagctgctgccgccgccgggcggacgggcggacgcgcggagctgggggcggcgcggcggggccggcggggcgcggcggggctgaccggccccgatgaggcggaaggagaagcggctcctgcaggcggtggcgctggtgctggcggccctggtcctcctgcccaacgtggggctttgggcgctgtaccgcgagcggcagcccgacggcacccctgggggatcgggggcggcggtggcgccggcggcgggacagggctcacacagtcgacaaaagaaaacgtttttcttgggagatgggcagaagctgaaggactggcatgacaaggaggccatccggagggacgctcagcgcgtaggaaatggagaacaaggaagaccttaccccatgaccgatgctgagagagtggatcaggcataccgagaaaatggatttaacatctacgtcagtgataaaatctccttgaatcgctctctcccagatatccggcacccaaactgcaacagcaagcgctacctggagacacttcccaacacaagcatcatcatccccttccacaacgagggctggtcctccctcctccgcaccgtccacagtgtgctcaatcgctcgcctccagagctggtcgccgagattgtactggtcgacgacttcagtgatcgagagcacctgaagaagcctcttgaagactacatggcccttttccccagtgtgaggattcttcgaaccaagaaacgggaagggctgataaggacccgaatgctgggggcctcagtggcaactggggatgtcatcacattcttggattcacactgtgaagccaatgtcaactggcttccccccttgcttgaccgcattgctcggaaccgcaagaccattgtgtgcccgatgattgatgtaattgaccatgacgactttcggtacgagacacaggcaggggatgccatgcggggagcctttgactgggagatgtactacaagcggatcccgatccctccagaactgcagaaagctgaccccagcgacccatttgagtctcccgtgatggccggtggactgttcgccgtggatcggaagtggttctgggaactcggcgggtatgacccaggcttggagatctggggaggggagcagtatgaaatctccttcaaggtgtggatgtgtgggggccgcatggaggacatcccctgctccagggtgggccatatctacaggaagtatgtgccctacaaggtcccggccggagtcagcctggcccggaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttgaaccatttcctagtgccttgctagacaaacataaaggggcagggttgtggggaggggaacgtttttggtggtgtgtgcagttcctactggatgagtgtgtgtttcttaatgtctcatttcaagcaggagatgttgggtctggagcaagatctgagactgagatgtcccccaagggtgacaggtcagatttatttcagtcagtgcaagtcacactccaaactaaaggctgggcagtgcgtttagtctgtggcctagaagacctcatcagcccccgagaggaggccttgcattacctcactgggacctgtttgggggccatccctgcggtccaccctctgaacccccagcatgtttgtcctgtttctcaccattgggttaaggggtgccgagcactagctagacttccacatagtcccaccccaagtgggcggcagtgttcctggcatgaccaggattcctgtgaaagcaggagcagcagcaagccgtcccgggcctgcctttcccatcctttggttctcctttccagtctgggttcacaccctgaaaagggatgggtgtgtcctctgagcactctggcatttgtcattgctgagcccatatcagtaggtcctgggacttgacaaagtatgtgggaggggaaggaaggacagaacttgactggctccatttcatggaccaactgatcaattgccagtactaagccactcattgttatggcttcctttttgaaaaccacctgtctcaaggattcaggtttctgctcacatccccagctgatgctcaataaaactcagccaggagcatatggagatgctgacagccaggtaatgggtgagactgtggggtcccttttcctctaaagcctttactctgaggataaggtcacaaagtagggtgtgacttgaaagtatcgtgaccatgtggcccaccagcagcctttccaaaggggaactccagagacatttcataatgcaaacagcactgttgctttaagaacaaggcctttggaggtggctaaacttgcacgcacgtgtgtgaaaagccatcccatcttctgcctccagttggagctttcagctgttaaaacagtcagaaactattgattcttccctttaggaaaaaatgctcaggcagaacggggtacatccacaggaggaatcggacgagaggatgtgacattcggtccaggagagaaagagcagtttctgttaaagatgtaacaaatggatttccaaagtctacatgacattcacttttcaaacttcccaccagttgaatttctttttttccttaagaaacaggtgatgtcttggaaaacagctccttatgtctctctgtgcatctccattttcctagtctctggagtctcaaaaagagtggcaaagcactttacagtagtaactgaggaatcagagtctctgcttcagcgatatctagtttgtacagttgggtgatcttttgtaattcctaggaggtaatgcatttttaatgttttctgaagctttgtaagtgtgagagagggacaagaagtgcagttctgttctggaattccttattgctttcaacggacactctttgtgaaaaatccaagtaatattttagttcaaacttgatcttgagccaaggcccactgccacctctgggatgggagtcggacctacataccaagtgacaagttcaccttaacatctgcttccagaatggctttgattcagccgtgccaggcaacagaacagggtcagactcctgctctgttattggcttgaagactaggatcccaaaggggttggaggcagggaatatttgaaaattcagactggaattccaggccaaaagctcaagaccaccagcctctcctcctgcctggaaaaataagcctttgtgaaagactgatttaccatgtacaattgtgattgtgaacgttgttgagtaaacctccagactttctctaaa

SEQ ID NO: 167645 - DNA, 3778 bp, Homo sapiens
  Payload ID: 12981
  Gene Symbol: GALNT10
  Gene Name: polypeptide N-acetylgalactosaminyltransferase 10
  Uniprot ID: Q86SR1
  ENST ID: ENST00000377661
  CDS Start-End: 94-1719
gagctgctgccgccgccgggcggacgggcggacgcgcggagctgggggcggcgcggcggggccggcggggcgcggcggggctgaccggccccgatgaggcggaaggagaagcggctcctgcaggcggtggcgctggtgctggcggccctggtcctcctgcccaacgtggggctttgggcgctgtaccgcgagcggcagcccgacggcacccctgggggatcgggggcggcggtggcgccggcggcgggacagggctcacacagtcgacaaaagaaaacgtttttcttgggagatgggcagaagctgaaggactggcatgacaaggaggccatccggagggacgctcagcgcgtaggaaatggagaacaaggaagaccttaccccatgaccgatgctgagagagtggatcaggcataccgagaaaatggatttaacatctacgtcagtgataaaatctccttgaatcgctctctcccagatatccggcacccaaactgcaacagcaagcgctacctggagacacttcccaacacaagcatcatcatccccttccacaacgagggctggtcctccctcctccgcaccgtccacagtgtgctcaatcgctcgcctccagagctggtcgccgagattgtactggtcgacgacttcagtgatcgagaccgcattgctcggaaccgcaagaccattgtgtgcccgatgattgatgtaattgaccatgacgactttcggtacgagacacaggcaggggatgccatgcggggagcctttgactgggagatgtactacaagcggatcccgatccctccagaactgcagaaagctgaccccagcgacccatttgagtctcccgtgatggccggtggactgttcgccgtggatcggaagtggttctgggaactcggcgggtatgacccaggcttggagatctggggaggggagcagtatgaaatctccttcaaggtgtggatgtgtgggggccgcatggaggacatcccctgctccagggtgggccatatctacaggaagtatgtgccctacaaggtcccggccggagtcagcctggcccggaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttg

SEQ ID NO: 167646 - DNA, 4344 bp, Homo sapiens
  Payload ID: 12981
  Gene Symbol: GALNT10
  Gene Name: polypeptide N-acetylgalactosaminyltransferase 10
  Uniprot ID: Q86SR1
  ENST ID: ENST00000425427
  CDS Start-End: 138-1238
gcggagttggagcggggccggcgccgcagccgcttctgctggctgagctgctgccgccgccgggcggacgggcggacgcgcggagctgggggcggcgcggcggggccggcggggcgcggcggggctgaccggccccgatgaggcggaaggagaagcggctcctgcaggcggtggcgctggtgctggcggccctggtcctcctgcccaacgtggggctttgggcgctgtaccgcgagcggcagcccgacggcacccctgggggatcgggggcggcggtggcgccggcggcgggacagggctcacacagtcgacaaaagaaaacgtttttcttgggagatgggcagaagctgaaggactggcatgacaaggaggccatccggagggacgctcagcgcgtaggaaatggagaacaaggaagaccttaccccatgaccgatgctgagagagtggatcaggcataccgagaaaatggatttaacatctacgtcagtgataaaatctccttgaatcgctctctcccagatatccggcacccaaactgcaacagcaagcgctacctggagacacttcccaacacaagcatcatcatccccttccacaacgagggctggtcctccctcctccgcaccgtccacagtgtgctcaatcgctcgcctccagagctggtcgccgagattgtactggtcgacgacttcagtgatcgagagcacctgaagaagcctcttgaagactacatggcccttttccccagtgtgaggattcttcgaaccaagaaacgggaagggctgataaggacccgaatgctgggggcctcagtggcaactggggatgtcatcacattcttggattcacactgtgaagccaatgtcaactggcttccccccttgcttgaccgcattgctcggaaccgcaagaccattgtgtgcccgatgattgatgtaattgaccatgacgactttcggtacgagacacaggcaggggatgccatgcggggagcctttgactgggagatgtactacaagcggatcccgatccctccagaactgcagaaagctgaccccagcgacccatttgagtctcccgtgatggccggtggactgttcgccgtggatcggaagtggttctgggaactcggcgggtatgacccaggcttggagatctggggaggggagcagtatgaaatctccttcaaggtgagccagctctccagacgccccgttcttggcacagcctcctgagtgcctgtcccagtaggtgtctcagcttctgcctgagcttggaaagactggaggcctcagggttctgtagcccttctgcccatcaggtgaagaagacaggggctcatgggccactctttgttgtggggtgggggggtgtgggagggaaggggagtactctccagctgccaaaggctggtcctcaccacagctctgactggcatttgccttgtgtcttcttaagatgttggaataaggtcttgcttctactcagatggcaggtctgagattgagatgtccagcaaataagcagtgggccagagaagctaggaaggccaaacaggatacgtaggcctagaggagtcctctcagtcaccccaagttttccctttgtacctgttgctctaggagtttgacaaagaccagtgagcataagctccagttgtaaagttacaaaggcctggattcagatcccagctccatcatcaggagctatctgactttgggcaagttagatcacccccccgagctttctttcctcatctgaaataagggaataataatactacctagcttacagagctatcgtgaagattaaatgagatcatgtctagaaagtgcttagcatacaacctgggaacatgaccagcaattaataattggtagaaattgttaaagtttcggtgagtaaatatttactgtaacctacttgaccagcctatggactctggaagctttctgacagtagtggtaaaggagttactagttaactaataactaattaagcacccaaacttccaaggctacattctccactttatttgtgggagtctgtcttgttctcaagtgaaagcttggaccttctgaggggagggttagcttgtcccatgcccttgtggcctgtcagagtcagcttctaacagcttagacccctggctaaggcatatccccagcccacaagggacagatagcaccattactgatctgacccctgtgaacacacaactctgatgccccctcatcgggcctcaactttcagtgcaaaggaccattgtcaggcacagtgaattaaggctttggtattggtgccagagtgccacgatcagatcctagctctgccgtgtcctgccagctgtgtgatcttgggcaaggaatcctcacctcactgagccttggtttctacttccataaagtgggtttaatgaaacgttaatcctcacagagttgttgagaggattaagtgagaccatgcttattaggtgcttcttaataaattatcctaaagattattatcaatacattaatattattatctgcaacagtggttgagtagttcagaactggagaacataaattcttgattagcccaaaaaaaaaaaaaacctacaattcttttgatgttatttaggtttgaaaagcagtttatatcctttttttttcttttcttttcttttgtttttttttttttgagatggagtttcactctgctgcccaggctggagtgcagtagtgcgatcttggctcactgcagcctccacctcctgggttcaagtgattctcctgcctcagcctcctgagtagctgggactacaggcgcccaccaccacgcccagctaatgtagagatagggtttcgacatgttgaccaggctggtcttgaccccctgacctcaggtgatccacccacctcggcctttcaaagtgctgggattacaggtgtgagccactgtgcctggccagtttatatctattttaaccaccagagttctgaagttgtctcccataaggagaccagccccctaaataaaattaatattcacataagggtaatgttcaaaatatgtaacaactgtgataacacaagcacatccagtcagaacagataccagctataaacaatggtgcatccactccagcgtgtaacaagtgaagttcggtcctgatcatagctaacaggacagtgtgccaagcccttcatacatgctgacttgtttaatcctcacaacaaccttaggagagttgtatcattattatacccgtttcaccaggaaggcaagcaaagctcagaccaaggcctcgcacagccggaagaagcagaactggggcccaaacgcaggtctgcttgactccaaagcccacgctctgacctgctatttttgttgttgtttaaatcatacccagactgttctgaaaacctgccatgttttatggacctctgcctcaccctttctgggattttttttttttttttgcctcttctggtattattcctagtttacttggatattctgcaatttcttagttaatggaattaataacaatctaagtcggaagtggcaaatagggccaggaatggtggccgagatgggaggatctcttgagcctaggagtttgagaccagcctggacaacacaacacgaccccatctcattaaaaaaaaaaaaaaaaagaaggaaagaaagagagagagagaaggagtggggagggagagagggagggggaaagggagagagagagacagagagagagacacagcaaataggtttctactccctgccaggccaactctgatccattggtaggggctgccccaggtgggtgttgatatgcattctgaggctgcttccaagcttatcagcaaagagtagtcagtgggggagggatctttttgtgtttcactcaccgccatatcccaagtacctaaagcctggtccaacacagaaaagacactatgagaccaatttttatgagtcataatttttattattgtattaaatcttttctaaaattatatttatataaatatcttataaatattctaaaaatatgtaaaatgtataaaagtctagtagttctgatataacactgtcagccataattctggttatcatgttaaaatactacatataataaaataactaaattcaagaccagcctggccaacattgtgaaaccccatctttactaaaaatacaaaaattagccaggcgtggtggtacatgcctgtaattccagctactcaggaggtggagacaggagaattgcttgaagctgggaggcagaggttgcagtgagccgagatcgtgccactgcactctaatctgggcgacaaagcgagactccatgtc

SEQ ID NO: 167647 - DNA, 4359 bp, Homo sapiens
  Payload ID: 12981
  Gene Symbol: GALNT10
  Gene Name: polypeptide N-acetylgalactosaminyltransferase 10
  ENST ID: ENST00000520647
  CDS Start-End: 133-741
gttggagcggggccggcgccgcagccgcttctgctggctgagctgctgccgccgccgggcggacgggcggacgcgcggagctgggggcggcgcggcggggccggcggggcgcggcggggctgaccggccccgatgaggcggaaggagaagcggctcctgcaggcggtggcgctggtgctggcggccctggtcctcctgcccaacgtggggctttgggcgctgtaccgcgagcggcagcccgacggcacccctgggggatcgggggcggcggtggcgccggcggcgggacagggctcacacagtcgacaaaagaaaacgtttttcttgggagatgggcagaagctgaaggactggcatgacaaggaggccatccggagggacgctcagcgcgtaggaaatggagaacaaggaagaccttaccccatgaccgatgctgagagagtggatcaggcataccgagaaaatggatttaacatctacgtcagtgataaaatctccttgaatcgctctctcccagatatccggcacccaaactgcaacagcaagcgctacctggagacacttcccaacacaagcatcatcatccccttccacaacgagggctggtcctccctcctccgcaccgtccacagtgtgctcaatcgctcgcctccagagctggtcgccgagattgtactggtcgacgacttcagtgatcgagatctgccgactgcatcaactccctctccctttgtgtgctagagacccttcagcatacgcagctctgggatgatgccaggattccatttggagacttctgcacccgttgcttttgtgtcttcccatctgcatagcacctgaagaagcctcttgaagactacatggcccttttccccagtgtgaggattcttcgaaccaagaaacgggaagggctgataaggacccgaatgctgggggcctcagtggcaactggggatgtcatcacattcttggattcacactgtgaagccaatgtcaactggcttccccccttgcttgaccgcattgctcggaaccgcaagaccattgtgtgcccgatgattgatgtaattgaccatgacgactttcggtacgagacacaggcaggggatgccatgcggggagcctttgactgggagatgtactacaagcggatcccgatccctccagaactgcagaaagctgaccccagcgacccatttgagtctcccgtgatggccggtggactgttcgccgtggatcggaagtggttctgggaactcggcgggtatgacccaggcttggagatctggggaggggagcagtatgaaatctccttcaaggtgtggatgtgtgggggccgcatggaggacatcccctgctccagggtgggccatatctacaggaagtatgtgccctacaaggtcccggccggagtcagcctggcccggaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggaggcgctttcaaggtatggtccctggaccacctgcacctgagtcacctggaatgggggtaaaatctggttcctggacctgtcggttcaatttctccaggagtagggccagggagtcctttaccaactcctcacctccactcccccaccaccaacccaggactctgcatactctacaatactacttacagcagtgctttaaggattacattctgtggactgagtcttccttcattgagaggctcaagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatata

SEQ ID NO: 167648 - DNA, 2371 bp, Homo sapiens
  Payload ID: 12982
  Gene Symbol: GALNT11
  Gene Name: polypeptide N-acetylgalactosaminyltransferase 11
  Uniprot ID: Q8NCW6
  ENST ID: ENST00000422997
  CDS Start-End: 173-781
tgtcttccacaggtctatagtgagcgagagctgctactttttacttgggcattcattcaaagtgttgaagaataacagcctctaccatcccttattcactggctcatcagctgtcccaggttttgctcttctaggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttggtaaggaatgctgcacctggtaacattggatccaggctgtcagtcactacagcactgacaaacactaacacagctgaactttcaagtacgtggtaggtggggatcctacacgtgcagtcacagctgggctgaccacaaataagtctgaagaaatccattatctttgtaacctgcttataaactatgctacccaaatttgggccgtgaaattttttccgtggcttactttaaaaaacacacctctttttatttgaaataactgtaggttcacaggaagttacaaagacggcctatgtacctttatccagttgctccatcataaaattcccctgtcagaaccaggaatccacattggtacagtgtgtgtggtccagggtcattctgtcacacaggtggactcccacaaccctcactgcaatgatacagaactgtttcctcacccggagggcccttgtgctgcctctttctagtcacacctcctgctttcctctactcttccccagtccctgaaaccacgactctatgattttgtttccatctctgattttgttatttcaagaatgtcatataaatggaatcacacggtatgtgaccttttgagatgggcttttttcatttggcatgatgccttggcttatgcttctctattaagtctcttacactgatcgtccccagataaaagtggattgcattctgatagctcctcaatgatctctgaatgccagtattttatgattcactacatattctatattctgtacgcctttcttaattcaacatagactcttgctaagaatggctttgtgtacccaaacaggatagaaggctttttattacactgctcattcagctctcagtgaccttgcaagaaaggctggaagcccattttatagagggagaaatataaaaagtaatttgctcagaccccatagctgttaagtagtagagtggaaatgagacctctggtctgcatagctccaagccttctgctcttttcatgacagcaggctgcaggaacacagtggtacaggtgtatgccagtgactttttcatgcactcgagcgtttattaagtaccacttgtatcaacatcagagttggtataccagtatacttaaatatagaaggtaaagaaatggagagagtcatgggagcaaaattctcaaaccttggccaaaaacaaacaaacaaaaaacctaataaataaatctgagtctggaccacgtagaagattggttacatactgatttctagaatttatggttggtttttgtttttttttaagtcaacttgtattttggttttcactttgtggctattttacctaaaaggaaaaattcataatttgaggtggtttgtatattaactatggaaagaattactgcttattatcttacacgatctttcaagttattctgaaatatacaggtgaatgacatagaattccttaaaaaatatttagcaaccttggaagaaagatgctaaattaataaaaggacatattcaatgctgttcttgttattcttggtaggggcaatagaagttgtttcttaactattttgaaatggactaagacttaataaattcctttgtaataaaaggcatttatatctc

SEQ ID NO: 167649 - DNA, 600 bp, Homo sapiens
  Payload ID: 12982
  Gene Symbol: GALNT11
  Gene Name: polypeptide N-acetylgalactosaminyltransferase 11
  ENST ID: ENST00000431940
  CDS Start-End: 1-196
gatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaagacacagcccacacacgcagaccctcctgggagttttccgtaatttttaagaacatcgatgactgagactcacgagtttgagacccactgatctcatatatacgcctgtttcattgattctcagatacagtttaaggagcagtatttttccttaagacctgacctgaagacgaaaagctatggcaatatcagtgagcgtgtggaactgagaaagaagttgggctgtaaatcatttaaatggtatttggataatgtatacccagagatgcagatatctgggtcccacgccaaaccccaacaacccatttttgtcaatagagggccaaaacgacccaaagtccttcaacgtggaaggctctatcacctccagaccaacaaatgcctggtggcccagggccgcccaagtcagaagggaggtctcgtggtgcttaaggcctgtgactacag

SEQ ID NO: 167650 - DNA, 580 bp, Homo sapiens
  Payload ID: 12982
  Gene Symbol: GALNT11
  Gene Name: polypeptide N-acetylgalactosaminyltransferase 11
  ENST ID: ENST00000423337
  CDS Start-End: 126-580
ctgcgggtcggactggggctgtggcgggagagaagatgccgcagcccgagtcccagaaggcggcgatcctgggctgcgggcaaggcggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataa

SEQ ID NO: 167651 - DNA, 626 bp, Homo sapiens
  Payload ID: 12982
  Gene Symbol: GALNT11
  Gene Name: polypeptide N-acetylgalactosaminyltransferase 11
  ENST ID: ENST00000431668
  CDS Start-End: 332-626
ctgaggaggcgcggccgccactgcgcccagcgcctgcgcgacgcctggctgctgggccccggggcagttcagcccgcgccgctcctgcgggtcggactggggctgtggcgggagagaagatgccgcagcccgagtcccagaaggcggcgatcctgggctgcgggcaaggcgtcctctgtaagcaggaagtgtcccagtctgacgtggctgctgcgtaaatgtgtccggaattggttccttccagtggattcttggtctcgctgacttcaagaatgaagccacggactgtcgcggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattag

SEQ ID NO: 167652 - DNA, 1231 bp, Homo sapiens
  Payload ID: 12982
  Gene Symbol: GALNT11
  Gene Name: polypeptide N-acetylgalactosaminyltransferase 11
  ENST ID: ENST00000447778
  CDS Start-End: 148-549
ggcagttcagcccgcgccgctcctgcgggtcggactggggctgtggcgggagagaagatgccgcagcccgagtcccagaaggcggcgatcctgggctgcgggcaaggcggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattagatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttgatgatttgaaaggagaactagatgaatatgtccaaaaatacctccctggaaaaattaaagtcataagaaatacaaagcgtgaggggttgattcgagggagaatgattggcgcggcccacgcgacaggagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtcaccaacaatggctggaggtttgtttgccatgaacagacagtatttccatgaacttggacagtatgatagtggcatggatatctggggaggagaaaatttggaaatatcatttcggatctggatgtgtggcggtaagctcttcatcatcccttgctctagagtaggacacattttccgaaaaaggcgaccatatggatctcccgaaggccaggacaccatgacacacaactctttgcggctggc

SEQ ID NO: 167653 - DNA, 2727 bp, Homo sapiens
  Payload ID: 12982
  Gene Symbol: GALNT11
  Gene Name: polypeptide N-acetylgalactosaminyltransferase 11
  Uniprot ID: Q8NCW6
  ENST ID: ENST00000430044
  CDS Start-End: 231-2057
gactgggcgagggccctgggcctgaggaggcgcggccgccactgcgcccagcgcctgcgcgacgcctggctgctgggccccggggcagttcagcccgcgccgctcctgcgggtcggactggggctgtggcgggagagaagatgccgcagcccgagtcccagaaggcggcgatcctgggctgcgggcaaggcggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttgatgatttgaaaggagaactagatgaatatgtccaaaaatacctccctggaaaaattaaagtcataagaaatacaaagcgtgaggggttgattcgagggagaatgattggcgcggcccacgcgacaggagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtcaccaacaatggctggaggtttgtttgccatgaacagacagtatttccatgaacttggacagtatgatagtggcatggatatctggggaggagaaaatttggaaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggagcagtatttttccttaagacctgacctgaagacgaaaagctatggcaatatcagtgagcgtgtggaactgagaaagaagttgggctgtaaatcatttaaatggtatttggataatgtatacccagagatgcagatatctgggtcccacgccaaaccccaacaacccatttttgtcaatagagggccaaaacgacccaaagtccttcaacgtggaaggctctatcacctccagaccaacaaatgcctggtggcccagggccgcccaagtcagaagggaggtctcgtggtgcttaaggcctgtgactacagtgacccaaatcagatctggatctataatgaagagcatgaattggttttaaatagtctcctttgtctagatatgtcagagactcgctcatcagacccgccacggctcatgaaatgccacgggtcaggaggatcccagcagtggacctttgggaaaaacaatcggctataccaggtgtcggttggacagtgcctgagagcagtggatcccctgggtcagaagggctctgtcgccatggcgatctgcgatggctcctcttcacagcagtggcatttggaaggttaaggtggatgctgtggtgggaacgttgcttcatcaggcgttgcctccggtgtggagtttggggctttaggaaagcctgggttgggtggagcagaaccatcttggagaagatgacagttccctgtcctcccggagatgcctgggtgtgttagcagaggtgacacgtgtctgacagagacgggagctctgagtgtccacgggtgaagaagtgagtgtccacgggtgaagaagtgagtatgtttcacctggacattaaggtgatgtttgagctgctgttaaggaatttcttgcttatagaggcaaaccacagtatcattttaactctagaattgggcttgtacagaaggataaaacccaggaaaatggatatttctattcagatttatttatgcctctttttaatcccctttaatgatgcagtggtttttatctgatcaggaacttgtcatgatttcctttcttagacttcataggagatagtgctttaaaaaaaaaaaaaacttctattatttgtttagtatgttgtaagtagatcattttaaaaaactgaatctatattatgtttaacttcagaaggcatcatttataagacagtatggcagttaattataaaattattttgatgaattatgatacaatctacataataaagaatccttttgattatttagga

SEQ ID NO: 167654 - DNA, 716 bp, Homo sapiens
  Payload ID: 12982
  Gene Symbol: GALNT11
  Gene Name: polypeptide N-acetylgalactosaminyltransferase 11
  ENST ID: ENST00000419245
  CDS Start-End: 157-716
tttcactgccgttggttctctgagcattaacccacaggcctgaggttttcattgttgaaccctttttaaaaactcagtactatccatacatcttcttgtatttgaatatccgttaactgaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcat

SEQ ID NO: 167655 - DNA, 2555 bp, Homo sapiens
  Payload ID: 12982
  Gene Symbol: GALNT11
  Gene Name: polypeptide N-acetylgalactosaminyltransferase 11
  Uniprot ID: Q8NCW6
  ENST ID: ENST00000415421
  CDS Start-End: 356-964
attactcttcccctcccctgccagagggatctctctgggatcttttaccttagtgcctggtggagttcctggaggtaaagcccacagaagtgtgggtctcgcacctcctgagactgcttccccgagtttctcactctcactagtccacaccgagcatccagcaccagcttatggctctggcagtttctgctccaggtctatagtgagcgagagctgctactttttacttgggcattcattcaaagtgttgaagaataacagcctctaccatcccttattcactggctcatcagctgtcccaggttttgctcttctaggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttggtaaggaatgctgcacctggtaacattggatccaggctgtcagtcactacagcactgacaaacactaacacagctgaactttcaagtacgtggtaggtggggatcctacacgtgcagtcacagctgggctgaccacaaataagtctgaagaaatccattatctttgtaacctgcttataaactatgctacccaaatttgggccgtgaaattttttccgtggcttactttaaaaaacacacctctttttatttgaaataactgtaggttcacaggaagttacaaagacggcctatgtacctttatccagttgctccatcataaaattcccctgtcagaaccaggaatccacattggtacagtgtgtgtggtccagggtcattctgtcacacaggtggactcccacaaccctcactgcaatgatacagaactgtttcctcacccggagggcccttgtgctgcctctttctagtcacacctcctgctttcctctactcttccccagtccctgaaaccacgactctatgattttgtttccatctctgattttgttatttcaagaatgtcatataaatggaatcacacggtatgtgaccttttgagatgggcttttttcatttggcatgatgccttggcttatgcttctctattaagtctcttacactgatcgtccccagataaaagtggattgcattctgatagctcctcaatgatctctgaatgccagtattttatgattcactacatattctatattctgtacgcctttcttaattcaacatagactcttgctaagaatggctttgtgtacccaaacaggatagaaggctttttattacactgctcattcagctctcagtgaccttgcaagaaaggctggaagcccattttatagagggagaaatataaaaagtaatttgctcagaccccatagctgttaagtagtagagtggaaatgagacctctggtctgcatagctccaagccttctgctcttttcatgacagcaggctgcaggaacacagtggtacaggtgtatgccagtgactttttcatgcactcgagcgtttattaagtaccacttgtatcaacatcagagttggtataccagtatacttaaatatagaaggtaaagaaatggagagagtcatgggagcaaaattctcaaaccttggccaaaaacaaacaaacaaaaaacctaataaataaatctgagtctggaccacgtagaagattggttacatactgatttctagaatttatggttggtttttgtttttttttaagtcaacttgtattttggttttcactttgtggctattttacctaaaaggaaaaattcataatttgaggtggtttgtatattaactatggaaagaattactgcttattatcttacacgatctttcaagttattctgaaatatacaggtgaatgacatagaattccttaaaaaatatttagcaaccttggaagaaagatgctaaattaataaaaggacatattcaatgctgttcttgttattcttggtaggggcaatagaagttgtttcttaactattttgaaatggactaagacttaataaattcctttgtaataaaaggcatttatatctca

SEQ ID NO: 167656 - DNA, 717 bp, Homo sapiens
  Payload ID: 12982
  Gene Symbol: GALNT11
  Gene Name: polypeptide N-acetylgalactosaminyltransferase 11
  ENST ID: ENST00000447796
  CDS Start-End: 238-717
attaacccacaggcctgaggttttcattgttgaaccctttttaaaaactcagtactatccatacatcttcttgtatttgaatatccgttaactgtacgcatagtggtcctacttggtggtttggaaaacagtgattctgtatttggtggatggtttaaagtatactgaagtgtctaacatatttattcttcttttttaggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctat

SEQ ID NO: 167657 - DNA, 521 bp, Homo sapiens
  Payload ID: 12982
  Gene Symbol: GALNT11
  Gene Name: polypeptide N-acetylgalactosaminyltransferase 11
  ENST ID: ENST00000446096
  CDS Start-End: 182-521
agcgcctgcgcgacgcctggctgctgggccccggggcagttcagcccgcgccgctcctgcgggtcggactggggctgtggcgggagagaagatgccgcagcccgagtcccagaaggcggcgatcctgggctgcgggcaaggcggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattagatgtaaagaaaagttctacccacctgacctgccagctgctagtgt

SEQ ID NO: 167658 - DNA, 2747 bp, Homo sapiens
  Payload ID: 12982
  Gene Symbol: GALNT11
  Gene Name: polypeptide N-acetylgalactosaminyltransferase 11
  Uniprot ID: Q8NCW6
  ENST ID: ENST00000434507
  CDS Start-End: 438-2264
attttgagttgattttcacatagaggtgggaggctagtttcattcctctgcatatgaatatccagttttcccagtatcatctattgaagatactgtcctttccccaagggatctctctgggatcttttaccttagtgcctggtggagttcctggaggtaaagcccacagaagtgtgggtctcgcacctcctgagactgcttccccgagtttctcactctcactagtccacaccgagcatccagcaccagcttatggctctggcagtttctgctccaggtctatagtgagcgagagctgctactttttacttgggcattcattcaaagtgttgaagaataacagcctctaccatcccttattcactggctcatcagctgtcccaggttttgctcttctaggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttgatgatttgaaaggagaactagatgaatatgtccaaaaatacctccctggaaaaattaaagtcataagaaatacaaagcgtgaggggttgattcgagggagaatgattggcgcggcccacgcgacaggagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtcaccaacaatggctggaggtttgtttgccatgaacagacagtatttccatgaacttggacagtatgatagtggcatggatatctggggaggagaaaatttggaaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggagcagtatttttccttaagacctgacctgaagacgaaaagctatggcaatatcagtgagcgtgtggaactgagaaagaagttgggctgtaaatcatttaaatggtatttggataatgtatacccagagatgcagatatctgggtcccacgccaaaccccaacaacccatttttgtcaatagagggccaaaacgacccaaagtccttcaacgtggaaggctctatcacctccagaccaacaaatgcctggtggcccagggccgcccaagtcagaagggaggtctcgtggtgcttaaggcctgtgactacagtgacccaaatcagatctggatctataatgaagagcatgaattggttttaaatagtctcctttgtctagatatgtcagagactcgctcatcagacccgccacggctcatgaaatgccacgggtcaggaggatcccagcagtggacctttgggaaaaacaatcggctataccaggtgtcggttggacagtgcctgagagcagtggatcccctgggtcagaagggctctgtcgccatggcgatctgcgatggctcctcttcacagcagtggcatttggaaggttaaggtggatgctgtggtgggaacgttgcttcatcaggcgttgcctccggtgtggagtttggggctttaggaaagcctgggttgggtggagcagaaccatcttggagaagatgacagttccctgtcctcccggagatgcctgggtgtgttagcagaggtgacacgtgtctgacagagacgggagctctgagtgtccacgggtgaagaagtgagtgtccacgggtgaagaagtgagtatgtttcacctggacattaaggtgatgtttgagctgctgttaaggaatttcttgcttatagaggcaaaccacagtatcattttaactctagaattgggcttgtacagaaggataaaacccaggaaaatggatatttctattcagatttatttatgcctctttttaatcccctttaatgatgcagtggtttttatctgatcaggaacttgtcatgatttcctttcttagacttcataggagatagtgcttt

SEQ ID NO: 167659 - DNA, 2735 bp, Homo sapiens
  Payload ID: 12983
  Gene Symbol: GALNT12
  Gene Name: polypeptide N-acetylgalactosaminyltransferase 12
  Uniprot ID: Q8IXK2
  ENST ID: ENST00000375011
  CDS Start-End: 1-1746
atgtgggggcgcacggcgcggcggcgctgcccgcgggaactgcggcgcggccgggaggcgctgttggtgctcctggcgctactggcgttggccgggctgggctcggtgctgcgggcgcagcgtggggccggggccggggctgccgagccgggacccccgcgcaccccgcgccccgggcggcgcgagccggtcatgccgcggccgccggtgccggcgaacgcgctgggcgcgcggggcgaggcggtgcggctgcagctgcagggcgaggagctgcggctgcaggaggagagcgtgcggctgcaccagattaacatctacctcagcgaccgcatctcactgcaccgccgcctgcccgagcgctggaacccgctgtgcaaagagaagaaatatgattatgataatttgcccaggacatctgttatcatagcattttataatgaagcctggtcaactctccttcggacagtttacagtgtccttgagacatccccggatatcctgctagaagaagtgatccttgtagatgactacagtgatagagagcacctgaaggagcgcttggccaatgagctttcgggactgcccaaggtgcgcctgatccgcgccaacaagagagagggcctggtgcgagcccggctgctgggggcgtctgcggcgaggggcgatgttctgaccttcctggactgtcactgtgagtgccacgaagggtggctggagccgctgctgcagaggatccatgaagaggagtcggcagtggtgtgcccggtgattgatgtgatcgactggaacaccttcgaatacctggggaactccggggagccccagatcggcggtttcgactggaggctggtgttcacgtggcacacagttcctgagagggagaggatacggatgcaatcccccgtcgatgtcatcaggtctccaacaatggctggtgggctgtttgctgtgagtaagaaatattttgaatatctggggtcttatgatacaggaatggaagtttggggaggagaaaacctcgaattttcctttaggatctggcagtgtggtggggttctggaaacacacccatgttcccatgttggccatgttttccccaagcaagctccctactcccgcaacaaggctctggccaacagtgttcgtgcagctgaagtatggatggatgaatttaaagagctctactaccatcgcaacccccgtgcccgcttggaaccttttggggatgtgacagagaggaagcagctccgggacaagctccagtgtaaagacttcaagtggttcttggagactgtgtatccagaactgcatgtgcctgaggacaggcctggcttcttcgggatgctccagaacaaaggactaacagactactgctttgactataaccctcccgatgaaaaccagattgtgggacaccaggtcattctgtacctctgtcatgggatgggccagaatcagtttttcgagtacacgtcccagaaagaaatacgctataacacccaccagcctgagggctgcattgctgtggaagcaggaatggatacccttatcatgcatctctgcgaagaaactgccccagagaatcagaagttcatcttgcaggaggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatgaagcctcgtgtatcaaggagcccatcgaaggagactgtggagccaggactctgcccaacaaagacttagctaagcagtgaccagaacccaccaaaaactaggctgcattgctttgaagaggcaatcattttgccatttgtgaaagttgtgttggatttagtaaaaatgtgaataagctttgtacttattttgagaactttttaaatgttccaaaataccctattttcaaagggtaatcgtaagatgttaacccttggtatttagaaaattaaaaccttataatatttttctatcaagatgtatattttacagtcgtgccttttactctcattagcaaaaaagataaagattttattttggtatttacaagaattcccaggtacgaagatatctgcatgggtggaaatcaggttcaagcaacgtactttgcattaactgataatacctcagctgcggggttaaagttttcccagtatagagagactgtcactaggaacattgtattgatttattcaggtcattgagatcttctagatgtattttaaaaagaatgctttttggttatgtgttgctaccacagttaacactccataatgttcatgtcagccaaagaggactaaccaaagctgaaatctcagagaacaatttgctttactaagctgagtcaacttgagagcgaacttctaacaatgccgcactgtagtgtggctggttctaccactatgactttaaaacatgtttatatcatttttaatttttatgatacggtagtgtcagggagaaatgtaatgttctatatgaaattcctttttcaagtttgttcattaataacagttattaatttaaatcagcgttagagtttgtgctgctgcaactgctgtgaaaatttctctgagtaattctgatttgtgaatgatcccagaccaaccctgagattttgtcaacctgattaagtcaatatgaatgattaaaaagatgtgagaacactga

SEQ ID NO: 167660 - DNA, 550 bp, Homo sapiens
  Payload ID: 12983
  Gene Symbol: GALNT12
  Gene Name: polypeptide N-acetylgalactosaminyltransferase 12
  ENST ID: ENST00000610463
  CDS Start-End: 1-95
agattaacatctacctcagcgaccgcatctcactgcaccgccgcctgcccgagcgctggaacccgctagcacctgaaggagcgcttggccaatgagctttcgggactgcccaaggtgcgcctgatccgcgccaacaagagagagggcctggtgcgagcccggctgctgggggcgtctgcggcgaggggcgatgttctgaccttcctggactgtcactgtgagtgccacgaagggtggctggagccgctgctgcagaggatccatgaagaggagtcggcagtggtgtgcccggtgattgatgtgatcgactggaacaccttcgaatacctggggaactccggggagccccagatcggcggtttcgactggaggctggtgttcacgtggcacacagttcctgagagggagaggatacggatgcaatcccccgtcgatgtcatcaggtctccaacaatggctggtgggctgtttgctgtgagtaagaaatattttgaatatctggggtcttatgatacaggaatggaagtttggggaggagaaaacctcgaat

SEQ ID NO: 167661 - DNA, 5536 bp, Homo sapiens
  Payload ID: 12984
  Gene Symbol: GALNT13
  Gene Name: polypeptide N-acetylgalactosaminyltransferase 13
  Uniprot ID: Q8IUC8
  ENST ID: ENST00000392825
  CDS Start-End: 568-2238
gggagaagtgaccaggcggcggcggctctgctgaggtgacaacgtgctagcagccctcgctcgctctgggcgcctcctcggcctcagcgtccgctctggccgcgctcgaggagcccttcagcccgccgctgcgctatgaaggcccctctctggggctggccgaggctggagccggctccctctgctcgcgggcaagtgtgaagagagaggcgcgggcgggagccggggctgcgcgcggcgctcgcgggccggcgcgggttccaggtgagcgcggactcggcgagccccgcactcggcgcggccggccggcgcctgctgggcttgatctgaggctgaatcccgtgtgtggaccgccgttccctcttcgcgggatcgttggccaggatagcagatgcatttttgtagaagcattttgaggatgaatgtttgcaaatcattttgaaattgccaagtgccacatacatggaatgtatcctgctttcatcttggagttcacctgtgtggcttggatttatcacagtagcatttgtcttcaatctgtgtgttaactagaaatcaaggaaagacatgaggagatttgtctactgcaaggtggttctagccacttcgctgatgtgggttcttgttgatgtcttcttactgctgtacttcagtgaatgtaacaaatgtgatgacaagaaggagagatctctgctgcctgcattgagggctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaaggatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttaggatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgagataagaaatgttgaaaccaatcagtgtttagacaacatgggccgcaaggaaaatgaaaaagtgggtatattcaactgtcatggtatgggaggaaatcaggtattttcttacactgctgacaaagaaatccgaaccgatgacttgtgcttggatgtttctagactcaatggacctgtaatcatgttaaaatgccaccatatgagaggaaatcagttatgggaatatgatgctgagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatgtttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaactaaacaatcttgctcctagagtttatgttggatactcaattcttaaccaaaatcttggtctccacaaactctaccatcccttttctcttcactctatagacagtggcatgccattgatgctgtacagaattgcaggtgaaagggagaattttagacttaatttttaactctattgcacttaaagattttagttaggttaccactgtcattttcattttctatgttaaagaatacctttcagtgctgtgctccagtatctaaaaattttatcaccaggggaataaactcaatacacattcattaaacttttgttgtaattaaactgctatatattgtttgccatatattatggcccaaggaatatagttataatcaggctacattcacattttcttttctcatcttaaaaccctttatgttcaaaatacattagcagaggccatgaaagtgaaaaaaaatcagatttttgctagtaagtttttatatttgacatcattttaaatgctcaaagagttgccctatatatgcatgttatccattataaatgcactcagcagctaagagaaatttgagaggaaaagtggaagaagtgttttctggagcagaagattccacttctttggtcctcatctttacttaaaaagctcttatagaaaggattaatcattttgactgcatacaaactatgtctctgacatgcacatacactgctttataatgaaaatgaggacactttctgatggtcagtaaaatcttaaatgatttttgccactggtattccttcctcttttgactttttattggtacaactgtagggaagaatctacaacctggagcatttcaggtttgctctttaaatatagacacccctcaccatgagctctctgtgaatccgtgaatttcctaaaattgtaagcaaaatgttgaatatcagggcatttttttttctgaggtgggagtatgtcactcacagcaaacttggaaagaaggctatgactcccaagaggcagtgaaccattgccttaaattaatagcagcctctcaagtccattgaggcctcatgtaaaattcccatttttcatctttacactccttttctcccctcatttcctcttctccttactaaggtaaaaagaccctgcacagcattattacttaagttgaaaaagcttcaactctcaaggactcatgtataccatatgttccacttattgctttgttagtcaaaatgcatgttatgtagaaaatggtcaatggcaaatttttataaatacagctaccccatcaaagctgaacttgaaacgttttagcagaattttaaatatgtgaaagttcattgtggtcatggtgagaaaactaaaactacatgagtttcatgttagaaaagaatttttaaacaatcttcagatggcttgaacacgtgccattatagtatctaacaaaaagtggcataaaatattacaaaacatccaacactagaaagcaatgactaacatttaatttgtttacaaaaatgtttattgtcttcagtacaaaaagttaaaaccatgattggattcataatgcacttgtcttatcccttatttatggagctagactgacatatttcaaaccaatctcttctgtggtcttctccatctcagttaatgcaacttcaaccttccagatgctcaggtcaaaaactgaaagttgcttttgactcctctatttctgtttcaactctcgtctaatccaacagcaaatccccttgatgctacctttgaaatataactagaaaagaatgacttgccaccatatccactaggtgtcactacctctaacctttttaatcgcaatatgcttattatttagttccctaatttcccagtccttgtcttgaacaatcttttctcagtacaacagccatagtgattctgttaaccatgaatttgattgtgtcacttccctgctcacaatcttccaatgacttctccctccggtggccttcaaggtcctttatgagtgttacccctctacacgtccacaccactcaccacacatacatacacatgcacacacacacacatgcaattctacctttttctaacaccatctcttatctctcattattctgcctcttacttaccctattatggctcccaagaaagttcctgctttagtgttttgttccctctgccccagagagctccccttagtgatctcagttcaaatattatcttatcagtaagacaaacccttctcccatctgccttccctatcccctgtacctgacaatctatgagtttgcttctttatttctgtctatacttccccctccccagccccaaacatgcccatcacatgccctagaaggtaagtcccatgaaggcaggggctttgtcagttttgttcatttggtatttctggcatatatattctctaaatatttcttgaattaatgaactgaaaaatgtgtgttaaagttgctaagtgtaactgtatcatactttttttgtattttaaattttaaaataaaggctaatatatttagacaggatttccaaaaa

SEQ ID NO: 167662 - DNA, 2591 bp, Homo sapiens
  Payload ID: 12984
  Gene Symbol: GALNT13
  Gene Name: polypeptide N-acetylgalactosaminyltransferase 13
  Uniprot ID: Q8IUC8
  ENST ID: ENST00000409237
  CDS Start-End: 1-1686
atgaggagatttgtctactgcaaggtggttctagccacttcgctgatgtgggttcttgttgatgtcttcttactgctgtacttcagtgaatgtaacaaatgtgatgacaagaaggagagatctctgctgcctgcattgagggctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaaggatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttaggatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgagataagaaatgttgaaaccaatcagtgtttagacaacatgggccgcaaggaaaatgaaaaagtgggtatattcaactgtcatggtatgggaggaaatcaggtattttcttacactgctgacaaagaaatccgaaccgatgacttgtgcttggatgtttctagactcaatggacctgtaatcatgttaaaatgccaccatatgagaggaaatcagttatgggaatatgatgctgagtcttgtctctcagtgaacaaagtagctgatggctcccagcatcctactgtggaaacctgtaatgatagcactttgcaaaaatggctactaagaaactatacaagaatggaaatttttagaaatatttttgggaattctactgattacattctctaatgatttttggagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatgtttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaac

SEQ ID NO: 167663 - DNA, 1642 bp, Homo sapiens
  Payload ID: 12984
  Gene Symbol: GALNT13
  Gene Name: polypeptide N-acetylgalactosaminyltransferase 13
  ENST ID: ENST00000431076
  CDS Start-End: 1-169
tatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaaggctaatagaccatgagaacagcattagtgtacatccagatgacagaagagattgtaaaagaagtggagaagactttctgactttccctgctttcgtgacagtaaatattgtcttcttgcttttatatgacataaagatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttaggatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgagataagaaatgttgaaaccaatcagtgtttagacaacatgggccgcaaggaaaatgaaaaagtgggtatattcaactgtcatggtatgggaggaaatcaggtaaactctccctttttatcagcttcatgttttagagggaaaatattgttaaaactatcagtggagaccatggctcacatgttaataactataaactgagcttaataaataaatgtacactcaaatctagaactaatttggctattttattgtcccaaggatcttaaaggagagctgaaaaattaaaataaaaagagcaacactttcagtgtgcctacagttaatgaagatatccaaatattttagacacatctcatt

SEQ ID NO: 167664 - DNA, 528 bp, Homo sapiens
  Payload ID: 12984
  Gene Symbol: GALNT13
  Gene Name: polypeptide N-acetylgalactosaminyltransferase 13
  ENST ID: ENST00000422126
  CDS Start-End: 1-138
ttagacaacatgggccgcaaggaaaatgaaaaagtgggtatattcaactgtcatggtatgggaggaaatcagactcaatggacctgtaatcatgttaaaatgccaccatatgagaggaaatcagttatgggaatatgatgctgagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgt

SEQ ID NO: 167665 - DNA, 668 bp, Homo sapiens
  Payload ID: 12984
  Gene Symbol: GALNT13
  Gene Name: polypeptide N-acetylgalactosaminyltransferase 13
  ENST ID: ENST00000453715
  CDS Start-End: 1-321
gtattttcttacactgctgacaaagaaatccgaaccgatgacttgtgcttggatgtttctagactcaatggacctgtaatcatgttaaaatgccaccatatgagaggaaatcagttatgggaatatgatgctgagacccacactcttcttcatataatcacccagtcttgtctctcagtgaacaaagtagctgatggctcccagcatcctactgtggaaacctgtaatgatagcactttgcaaaaatggctactaagaaactatacaagaatggaaatttttagaaatatttttgggaattctactgattacattctctaatgatttttggagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacat

SEQ ID NO: 167666 - DNA, 606 bp, Homo sapiens
  Payload ID: 12984
  Gene Symbol: GALNT13
  Gene Name: polypeptide N-acetylgalactosaminyltransferase 13
  ENST ID: ENST00000450838
  CDS Start-End: 1-427
catatccccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgaggtattttcttacactgctgacaaagaaatccgaaccgatgacttgtgcttggatgtttctagactcaatggacctgtaatcatgttaaaatgccaccatatgagaggaaatcagttatgggaatatgatgctgagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtat

SEQ ID NO: 167667 - DNA, 510 bp, Homo sapiens
  Payload ID: 12984
  Gene Symbol: GALNT13
  Gene Name: polypeptide N-acetylgalactosaminyltransferase 13
  ENST ID: ENST00000434213
  CDS Start-End: 453-510
aacgtgctagcagccctcgctcgctctgggcgcctcctcggcctcagcgtccgctctggccgcgctcgaggagcccttcagcccgccgctgcgctatgaaggcccctctctggggctggccgaggctggagccggctccctctgctcgcgggcaagtgtgaagagagaggcgcgggcgggagccggggctgcgcgcggcgctcgcgggccggcgcgggttccagatgcatttttgtagaagcattttgaggatgaatgtttgcaaatcattttgaaattgccaagtgccacatacaatttaattggatttgagggaaatacaggctgcaatggtgggaatagttaaaatggaatgtatcctgctttcatcttggagttcacctgtgtggcttggatttatcacagtagcatttgtcttcaatctgtgtgttaactagaaatcaaggaaagacatgaggagatttgtctactgcaaggtggttctagccacttcgctgatgtgggttcttg

SEQ ID NO: 167668 - DNA, 2733 bp, Homo sapiens
  Payload ID: 12985
  Gene Symbol: GALNT14
  Gene Name: polypeptide N-acetylgalactosaminyltransferase 14
  Uniprot ID: Q96FL9
  ENST ID: ENST00000349752
  CDS Start-End: 641-2299
ggcatcccgagtgcaccgctcccgccccgccccgccttgccccaacccacgatggtctgggagctgcgcccagggcttggcgctggcggccccgcaacagcaccgagcgtttcggtcggcgggcggcggtagcgccccctctcagagccccgctcactcccacctgggctcgctccgagtcggcctgtctgtcgggcccgccctccccgctcactccctccgccctcgtgctcctcccggggtgcttggcacagcctcggattcctccctctcgctgctcgagtcagtttccctatcggcggcagcgggcaaggcggcggcggcggcggcggcagccgcggtggcggcgtggggaacatctcggcagccaccgcgcttctcccgctggagcgggcgtccagcttggctgccctcggtccttccctgccacgtttcgggtcgccctgcaccccccacccaggctcgcttctcttcgaagcgggaagggcgccttgcaggatcctgccgcccctccaaccggatcctgggtctagagctccccagagcgaggcgctcgccaggactcctgccccgccaaccctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgga

SEQ ID NO: 167669 - DNA, 2169 bp, Homo sapiens
  Payload ID: 12985
  Gene Symbol: GALNT14
  Gene Name: polypeptide N-acetylgalactosaminyltransferase 14
  Uniprot ID: Q96FL9
  ENST ID: ENST00000324589
  CDS Start-End: 62-1735
ctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaaggtttggtccttgtttttcaaggtggctgggatgagcccttgggcgcctcaggtgcctgtatcacccactcctccctaccaaagagggcatcttcctacaggaggacaccttgctgtatgtcatttcccatgtctcttgcaagaagctcagttccatttgcagactcaggtctttcttcaagtcagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgga

SEQ ID NO: 167670 - DNA, 2496 bp, Homo sapiens
  Payload ID: 12985
  Gene Symbol: GALNT14
  Gene Name: polypeptide N-acetylgalactosaminyltransferase 14
  Uniprot ID: Q96FL9
  ENST ID: ENST00000406653
  CDS Start-End: 465-2063
actgaaaaattagctggtgcctgtatttcaggcttattgtttcctaggatctcagggagatcaggccacgtggtctgtggattaattaaggcacccagataattggctattaatagatggccaattgatggctgccagctgggtgctgaattgactaatgtccttatggtgggcaggtggtctttatcagaagaggagctagctgaaagactttactaattaaagggtgaatcaggaaaagaagataagaggtagcttttttccccaccacttggtgtgatgttttacagtttacaaagcatttatatccacagttgcctcatttgatccttactgcgactttgtgaggtttggtccttgtttttcaaggtggctgggatgagcccttgggcgcctcaggtgcctgtatcacccactcctccctaccaaagagggcatcttcctacaggaggacaccttgctgtatgtcatttcccatgtctcttgcaagaagctcagttccatttgcagactcaggtctttcttcaagtcagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgg

SEQ ID NO: 167671 - DNA, 735 bp, Homo sapiens
  Payload ID: 12985
  Gene Symbol: GALNT14
  Gene Name: polypeptide N-acetylgalactosaminyltransferase 14
  ENST ID: ENST00000424136
  CDS Start-End: 1-116
cagtcttcggggtgctctggatcacggtgctgctgttcttctgggtaaccaagaggaagttggaggtgccgacgggacctgaagtgcagacccctaagggttcttcccaaagttagtgcagcctacacccaggattgaacaaagacagcttggaagttagaagcaagatggagtctgttagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgat

SEQ ID NO: 167672 - DNA, 982 bp, Homo sapiens
  Payload ID: 12985
  Gene Symbol: GALNT14
  Gene Name: polypeptide N-acetylgalactosaminyltransferase 14
  ENST ID: ENST00000455477
  CDS Start-End: 1-212
cagtcttcggggtgctctggatcacggtgctgctgttcttctgggtaaccaagaggaagttggaggtgccgacgggacctgaagtgcagacccctaaggtttggtccttgtttttcaaggtggctgggatgagcccttgggcgcctcaggtgcctgtatcacccactcctccctaccaaagagggcatcttcctacagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagagaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctg

SEQ ID NO: 167673 - DNA, 1619 bp, Homo sapiens
  Payload ID: 12985
  Gene Symbol: GALNT14
  Gene Name: polypeptide N-acetylgalactosaminyltransferase 14
  ENST ID: ENST00000430167
  CDS Start-End: 418-1619
cctcgtgctcctcccggggtgcttggcacagcctcggattcctccctctcgctgctcgagtcagtttccctatcggcggcagcgggcaaggcggcggcggcggcggcggcagccgcggtggcggcgtggggaacatctcggcagccaccgcgcttctcccgctggagcgggcgtccagcttggctgccctcggtccttccctgccacgtttcgggtcgccctgcaccccccacccaggctcgcttctcttcgaagcgggaagggcgccttgcaggatcctgccgcccctccaaccggatcctgggtctagagctccccagagcgaggcgctcgccaggactcctgccccgccaaccctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctca

SEQ ID NO: 167674 - DNA, 4669 bp, Homo sapiens
  Payload ID: 12986
  Gene Symbol: GALNT15
  Gene Name: polypeptide N-acetylgalactosaminyltransferase 15
  Uniprot ID: Q8N3T1
  ENST ID: ENST00000339732
  CDS Start-End: 504-2423
gaaaggaaaccaggcactgcctgccggctttacatctgttgatctgacctgactggaagcgtccaaagagggacggctgtcagccctgcttgactgagaacccaccagctcatcccagacacctcatagcaacctatttatacaaagggggaaagaaacacctgagcagaatggaatcattatttttttcccaaggagaaaaccggggtaaagggagggaagcaattcaatttgaagtccctgtgaatgggctttcagaaggcaattaaagaaatccactcagagaggacttggggtgaaacttgggtcctgtggttttctgattgtaagtggaagcaggtcttgcacacgctgttggcaaatgtcaggaccaggttaagtgactggcagaaaaacttccaggtggaacaagcaacccaggttctgctgcaagcttgaaggagcctggagcgggagaaagctaacttgaacatgacctgttgcatttggcaagttctagcaacatgctcctaaggaagcgatacaggcacagaccatgcagactccagttcctcctgctgctcctgatgctgggatgcgtcctgatgatggtggcgatgttgcaccctccccaccacaccctgcaccagactgtcacagcccaagccagcaagcacagccctgaagccaggtaccgcctggactttggggaatcccaggattgggtactggaagctgaggatgagggtgaagagtacagccctctggagggcctgccaccctttatctcactgcgggaggatcagctgctggtggccgtggccttaccccaggccagaaggaaccagagccagggcaggagaggtgggagctaccgcctcatcaagcagccaaggaggcaggataaggaagccccaaagagggactggggggctgatgaggacggggaggtgtctgaagaagaggagttgaccccgttcagcctggacccacgtggcctccaggaggcactcagtgcccgcatccccctccagagggctctgcccgaggtgcggcacccactgtgtctgcagcagcaccctcaggacagcctgcccacagccagcgtcatcctctgtttccatgatgaggcctggtccactctcctgcggactgtacacagcatcctcgacacagtgcccagggccttcctgaaggagatcatcctcgtggacgacctcagccagcaaggacaactcaagtctgctctcagcgaatatgtggccaggctggagggggtgaagttactcaggagcaacaagaggctgggtgccatcagggcccggatgctgggggccaccagagccaccggggatgtgctcgtcttcatggatgcccactgcgagtgccacccaggctggctggagcccctcctcagcagaatagctggtgacaggagccgagtggtatctccggtgatagatgtgattgactggaagactttccagtattacccctcaaaggacctgcagcgtggggtgttggactggaagctggatttccactgggaacctttgccagagcatgtgaggaaggccctccagtcccccataagccccatcaggagccctgtggtgcccggagaggtggtggccatggacagacattacttccaaaacactggagcgtatgactctcttatgtcgctgcgaggtggtgaaaacctcgaactgtctttcaaggcctggctctgtggtggctctgttgaaatccttccctgctctcgggtaggacacatctaccaaaatcaggattcccattcccccctcgaccaggaggccaccctgaggaacagggttcgcattgctgagacctggctggggtcattcaaagaaaccttctacaagcatagcccagaggccttctccttgagcaaggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggagaatgggatgattgtccacattctttctgggaaatgcatggaagctgtggtgcaagaaaacaataaagatttgtacctgcgtccgtgtgatggaaaagcccgccagcagtggcgttttgaccagatcaatgctgtggatgaacgatgaatgtcaatgtcagaaggaaaagagaattttggccatcaaaatccagctccaagtgaacttaaagagcttatatatttcatgaagctgatccttttgtgtgtgtgctcctggtgttaggagagaaaaaagctctatgaaagaatataggaagtttctccttttcacaccttatttcattgactgctggctgctttaaaaaaaaaaaaaaaggatccattgtaccgttgtcttcatcactgggaaatgattattacatagtacagaagattctttgtttttctccactgagcacttaacaattgctttctctctggcctggacattctctggcagcacctccaggatacataaattcaatggatcaatttatttgtcttcaaatggccttaacttggattgtctgtttggccaaccatgaaaattaaagagtgaagcagatgtaatggcctgacattccaaaaactctgaattgggtttattagcacaaatgttgtgttcatttgttgagccatatctcagaagaaggaaagggagctacagaaaggaggtttaggattgcagagaagatgcaagagcactttggcccaattctccagctcaacccagcagctgaaaagcttcaagagatctaggaaaagacattttcatgttaatgagaatttccaccattgtagagaatttccttcctactgagaatctacctctattccccctgccctagctcttctctaacttggttaaccataaccataaccagattcccttgcaatcgatttctctttagtcgttggtgttagaagtaccagcacaatttgagcattcccattaacaaaggtgttcacagttgagaaactctcctgccgggcgcggtggctcatgcctgtaattccagcactttgggaggcagagttgggaggatcacctgatgtcaggggtttgagaccagcctggtcaacattgcaaaaccttgtctctactaaaaatacaaaaattagctgggcatggtggcgcatacctgtaatcccagctacttgggaggctgaggcaagagaatcgcttgaacccaggaggcagaggttgcagtgagctgagatcatgccattgcactccaacctgggtgacagagtgagactccatctcaaaaaaaaaaaaaaagagagaaactctcctgatgccctgttacagggtttgcactgactggagcagaaacagcaacctttctaaaaaagcaaacctttttcctgggaggaaaatgccagagcctgagccaaaattcttatgacaggtaacatttgggtgttaatgtccatgagagctgacagggccatctctgagcccatataactgtctggaacccccaaatgtgtccacaggttgaatgtccatgagtgtgggaagaacacggctcatctggagcacagctgaggctagtaagagctaaatgactttccttgctatgacttggcttacctgaattagctgtaagagttgccgaatgggatgggttctgctatttaataaacagcattcatattcatttttccccagatggagttacctacctttccacatggtcagcttagaaatcttcccctaaagatgctaatctcctttgggctgtctcagaacacagtatccttcaaataagaaaaactgagtgggaagtgcagtgtttccaaacaatacctatcataactacgtattcattgtctacctgctaagtcaagggttcactgcatttctccttcctcagaatacactctggacctgtgctgtctaatatggtagccactaacaaaatgtggccattttgatggaaatccattaaaatcaaagaaaatttaaaactcaattcctcaattgggctggccacatttcaaatgctcactacccacctgtggctagggtctacttctactgtattggcgagcatggatatagaacatttcatcacagttctgttggaccaatctagatagattcattatcccatctagagaagagactttagtcactgtcttcttgcttcagacccatctatatttaaaacaaatttccctaaatcctgagactgagacggagctacaaattctcagatggcgaccgtgtaaatggtattagcggctgaagaaaaaaaatttttcaagacctctgttttttaactgaactttatcattggcattgtgggtctttgaagttgctgggataaattaatataattaaataaaagactgaatttaattgca

SEQ ID NO: 167675 - DNA, 572 bp, Homo sapiens
  Payload ID: 12986
  Gene Symbol: GALNT15
  Gene Name: polypeptide N-acetylgalactosaminyltransferase 15
  ENST ID: ENST00000430410
  CDS Start-End: 1-426
gctctgcccgaggtgcggcacccactgtgtctgcagcagcaccctcaggacagcctgcccacagccagcgtcatcctctgtttccatgatgaggcctggtccactctcctgcggactgtacacagcatcctcgacacagtgcccagggccttcctgaaggagatcatcctcgtggacgacctcagccagcaaggtagccacggctttcctccaggctcgtctgggacaactcaagtctgctctcagcgaatatgtggccaggctggagggggtgaagttactcaggagcaacaagaggctgggtgccatcagggcccggatgctgggggccaccagagccaccggggatgtgctcgtcttcatggatgcccactgcgagtgccacccaggctggctggagcccctcctcagcagaatagctggtgacaggagccgagtggtatctccggtgatagatgtgattgactggaagactttccagtattacccctcaaaggacctgcagcgtggggtgttggactggaagctggatttccactgggaacctttgccagagcatgtgaggaaggccc

SEQ ID NO: 167676 - DNA, 2416 bp, Homo sapiens
  Payload ID: 12986
  Gene Symbol: GALNT15
  Gene Name: polypeptide N-acetylgalactosaminyltransferase 15
  ENST ID: ENST00000437509
  CDS Start-End: 444-2297
gtccaaagagggacggctgtcagccctgcttgactgagaacccaccagctcatcccagacacctcatagcaacctatttatacaaagggggaaagaaacacctgagcagaatggaatcattatttttttcccaaggagaaaaccggggtaaagggagggaagcaattcaatttgaagtccctgtgaatgggctttcagaaggcaattaaagaaatccactcagagaggacttggggtgaaacttgggtcctgtggttttctgattgtaagtggaagcaggtcttgcacacgctgttggcaaatgtcaggaccaggttaagtgactggcagaaaaacttccaggtggaacaagcaacccaggttctgctgcaagcttgaaggagcctggagcgggagaaagctaacttgaacatgacctgttgcatttggcaagttctagcaacatgctcctaaggaagcgatacaggcacagaccatgcagactccagttcctcctgctgctcctgatgctgggatgcgtcctgatgatggtggcgatgttgcaccctccccaccacaccctgcaccagactgtcacagcccaagccagcaagcacagccctgaagccaggtaccgcctggactttggggaatcccaggattgggtactggaagctgaggatgagggtgaagagtacagccctctggagggcctgccaccctttatctcactgcgggaggatcagctgctggtggccgtggccttaccccaggccagaaggaaccagagccagggcaggagaggtgggagctaccgcctcatcaagcagccaaggaggcaggataaggaagccccaaagagggactggggggctgatgaggacggggaggtgtctgaagaagaggagttgaccccgttcagcctggacccacgtggcctccaggaggcactcagtgcccgcatccccctccagagggctctgcccgaggtgcggcacccactgtgtctgcagcagcaccctcaggacagcctgcccacagccagcgtcatcctctgtttccatgatgaggcctggtccactctcctgcggactgtacacagcatcctcgacacagtgcccagggccttcctgaaggagatcatcctcgtggacgacctcagccagcaaggacaactcaagtctgctctcagcgaatatgtggccaggctggagggggtgaagttactcaggagcaacaagaggctgggtgccatcagggcccggatgctgggggccaccagagccaccggggatgtgctcgtcttcatggatgcccactgcgagtgccacccaggctggctggagcccctcctcagcagaatagctggtgacaggagccgagtggtatctccggtgatagatgtgattgactggaagactttccagtattacccctcaaaggacctgcagcgtggggtgttggactggaagctggatttccactgggaacctttgccagagcatgtgaggaaggccctccagtcccccataagccccatcaggagccctgtggtgcccggagaggtggtggccatggacagacattacttccaaaacactggagcgtatgactctcttatgtcgctgcgaggtggtgaaaacctcgaactgtctttcaaggcctggctctgtggtggctctgttgaaatccttccctgctctcgggtaggacacatctaccaaaatcaggattcccattcccccctcgaccaggaggccaccctgaggaacagggttcgcattgctgagacctggctggggtcattcaaagaaaccttctacaagcatagcccagaggccttctccttgagcaaggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggaggatgagaacagggccaactctgctgctgctgaagcttatcaaaggcctttaacttttcagcagattgtgaacaatgggtaggacatcatttgcttcattcagagatcctcaagaaggcactgccgatcactctcctctaggcacagatcaagggtggcattgtttaatgtcttatttaaataaaatccagaaaaactgga

SEQ ID NO: 167677 - DNA, 2775 bp, Homo sapiens
  Payload ID: 12986
  Gene Symbol: GALNT15
  Gene Name: polypeptide N-acetylgalactosaminyltransferase 15
  ENST ID: ENST00000617544
  CDS Start-End: 22-612
caggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggagaatgggatgattgtccacattctttctgggaaatgcatggaagctgtggtgcaagaaaacaataaagatttgtacctgcgtccgtgtgatgaaaagcccgccagcagtggcgttttgaccagatcaatgctgtggatgaacgatgaatgtcaatgtcagaaggaaaagagaattttggccatcaaaatccagctccaagtgaacttaaagagcttatatatttcatgaagctgatccttttgtgtgtgtgctcctggtgttaggagagaaaaaagctctatgaaagaatataggaagtttctccttttcacaccttatttcattgactgctggctgctttaaaaaaaaaaaaaaaggatccattgtaccgttgtcttcatcactgggaaatgattattacatagtacagaagattctttgtttttctccactgagcacttaacaattgctttctctctggcctggacattctctggcagcacctccaggatacataaattcaatggatcaatttatttgtcttcaaatggccttaacttggattgtctgtttggccaaccatgaaaattaaagagtgaagcagatgtaatggcctgacattccaaaaactctgaattgggtttattagcacaaatgttgtgttcatttgttgagccatatctcagaagaaggaaagggagctacagaaaggaggtttaggattgcagagaagatgcaagagcactttggcccaattctccagctcaacccagcagctgaaaagcttcaagagatctaggaaaagacattttcatgttaatgagaatttccaccattgtagagaatttccttcctactgagaatctacctctattccccctgccctagctcttctctaacttggttaaccataaccataaccagattcccttgcaatcgatttctctttagtcgttggtgttagaagtaccagcacaatttgagcattcccattaacaaaggtgttcacagttgagaaactctcctgccgggcgcggtggctcatgcctgtaattccagcactttgggaggcagagttgggaggatcacctgatgtcaggggtttgagaccagcctggtcaacattgcaaaaccttgtctctactaaaaatacaaaaattagctgggcatggtggcgcatacctgtaatcccagctacttgggaggctgaggcaagagaatcgcttgaacccaggaggcagaggttgcagtgagctgagatcatgccattgcactccaacctgggtgacagagtgagactccatctcaaaaaaaaaaaaaaagagagaaactctcctgatgccctgttacagggtttgcactgactggagcagaaacagcaacctttctaaaaaagcaaacctttttcctgggaggaaaatgccagagcctgagccaaaattcttatgacaggtaacatttgggtgttaatgtccatgagagctgacagggccatctctgagcccatataactgtctggaacccccaaatgtgtccacaggttgaatgtccatgagtgtgggaagaacacggctcatctggagcacagctgaggctagtaagagctaaatgactttccttgctatgacttggcttacctgaattagctgtaagagttgccgaatgggatgggttctgctatttaataaacagcattcatattcatttttccccagatggagttacctacctttccacatggtcagcttagaaatcttcccctaaagatgctaatctcctttgggctgtctcagaacacagtatccttcaaataagaaaaactgagtgggaagtgcagtgtttccaaacaatacctatcataactacgtattcattgtctacctgctaagtcaagggttcactgcatttctccttcctcagaatacactctggacctgtgctgtctaatatggtagccactaacaaaatgtggccattttgatggaaatccattaaaatcaaagaaaatttaaaactcaattcctcaattgggctggccacatttcaaatgctcactacccacctgtggctagggtctacttctactgtattggcgagcatggatatagaacatttcatcacagttctgttggaccaatctagatagattcattatcccatctagagaagagactttagtcactgtcttcttgcttcagacccatctatatttaaaacaaatttccctaaatcctgagactgagacggagctacaaattctcagatggcgaccgtgtaaatggtattagcggctgaagaaaaaaaatttttcaagacctctgttttttaactgaactttatcattggcattgtgggtctttgaagttgctgggataaattaatataattaaataaaagactgaatttaattgc

SEQ ID NO: 167678 - DNA, 5708 bp, Homo sapiens
  Payload ID: 12987
  Gene Symbol: GALNT16
  Gene Name: polypeptide N-acetylgalactosaminyltransferase 16
  Uniprot ID: Q8N428
  ENST ID: ENST00000337827
  CDS Start-End: 328-2004
actcggcgcgcttctctcccagtgcgcagtggcctggtgggtcagccggcggcggctggagcgcggggccggccctgcgcacgaatgaatgggcgcccgggggacgcgcgcgctcggggctgaagggcattaggaccgtgaggatcgctccgcgatcctgtctctccctatcacccccccgcccccccacctctctcctttttctgctctgcaggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcatcaccttccacaatgaggcccgttccaccctgctgcgcacagtgaagagtgtcctgaaccgaactcctgccaacttgatccaggagatcattttagtggatgacttcagctcagatccggaagactgtctactcctgaccaggatccccaaggtcaagtgcctgcgcaatgatcggcgggaagggctgatccggtcccgagtgcgtggggcggacgtggctgcagctaccgttctcacctttctggatagccactgcgaagtgaacaccgagtggctgccgcccatgctgcagcgggtgaaggaggaccacacccgcgtggtgagtcccatcattgatgtcatcagtctggataattttgcctaccttgcagcatctgctgaccttcgtggagggttcgactggagcctgcatttcaagtgggagcagatccctcttgagcagaagatgacccggacagaccccaccaggcccataaggacgcctgtcatagctggaggaatcttcgtgatcgacaagtcctggtttaaccacttgggaaagtatgatgcccagatggacatctgggggggagagaattttgagctctccttcagggtgtggatgtgtggtggcagtctggagatcgtcccctgcagccgggtgggccatgtcttcaggaaacggcacccctacaacttccctgagggtaatgccctcacctacatcaggaatactaagcgcactgcagaagtgtggatggatgaatacaagcaatactactatgaggcccggccctcggccatcgggaaggccttcggcagtgtggctacgcggatagagcagaggaagaagatgaactgcaagtccttccgctggtacctggagaacgtctacccagagctcacggtccccgtgaaggaagcactccccggcatcattaagcagggggtgaactgcttagaatctcagggccagaacacagctggtgacttcctgcttggaatggggatctgcagagggtctgccaagaacccgcagcccgcccaggcatggctgttcagtgaccacctcatccagcagcaggggaagtgcctggctgccacctccaccttaatgtcctcccctggatccccagtcatactgcagatgtgcaaccctagagaaggcaagcagaaatggaggagaaaaggatctttcatccagcattcagtcagtggcctctgcctggagacaaagcctgcccagctggtgaccagcaagtgtcaggctgacgcccaggcccagcagtggcagctgttgccacacacatgacggagggattttcttgaagggtcagctattgcactgtgctgggaggctggctgtggctcctgtttgtgaagagaactcccagttccttttcacagccgctgagaacacatccacacatctaccccacggccttgtcttggaactgctcctgctatccccacaccctgcttcctcaccccactggctcttgggcaaatgactgttggtaccaggaccctgggggtctcccctacaaagcagaccagcctggggcagatatacctaccacaggagccccctgtctttcataggccaaggatccacatacccatagagttcatggattctagagggtctaggaatctcttgaaattgtccctaaaatactgcatgtgtgtgcatacatgcattttcctggggaaaaagtccatggcttctaaaagaggtccctgatccccaaagggcctgaacctctgctctggattgaagccactgtctgcccaagctgccaccccctaatcttcctccctggcgtgctcaaactgccatcgcctgctccctccacacggcccttggggtcagcagccaagtgtctgtggtccgcagcacctgctctggagggctctccagcagtttcgcctcctgactctcaccagcgtcctctcggcagcactcccgtgcccaagtgcacccctctggacttgccagcgcaggccccttcgctcccagggccatgctttgcctgtcctctgtcgtgatgtttcttccgcagccaggtgcagcctcagatcccctgttcatctgggaagcctcctgccacagcttaggacagaactgggcccagggcaaaggcctctccccagaggatggactagaaggcctgggccacactcgggcatggacctttggggctggggagccggggctgcgcctgttgaatgtaagaggactgctgaccagagggccttcaagagggtctctctgtcctttgctgtggtcagatcaggctctgcacttatcagccggtcctttgtggcaacgcagccctgttctgtttttgcttttcctcttcttgaccaaagcatgtgccactagctgtccttgaggacctcgtctttatgaaacacacacctggaataaaaccacttcttacatgtccacatgcaccagcgccttcctttctgcctccaggcctagcccttcagcacaccctcccccgcctcgtggggaaagtccgggcctcctttctgtaaaagtgaaactgaacatgctcaagtctagccctgtcctgcacctggtagcttgctcgtcggcctccatgccctgtggtgccccaggaactcctgactgctctggtgggggccaacaggtggccctactgcaagggcaggccttggaccaaaaccaggaatcagcacaggtcaggtggagcccaggctcctgtggcctcattatgggattctacttggggcttagaaatggaaagcaaattgcttctccaaataggtattgccctgccgccgtgcttgcctttagccagccctctctccttccctgtgagccaggcctgtcccctcggagctgccctcccctgctctaccacacaagaaggcagtggtacaaattcaggcaggacatacttcctgggtaaaaacagcaaaataattctgaaaagagtcttaccagaccagctttgcttgattgggtagcagatgctctgcctaatgttcccatggaaaccaatggaaaacccccaccatgtctgtgatcagaagctgaacctacccaggtaaaaataaacgctgcttcaacatacatatgaactgcagctggcaggccagcacaccactagcctctcctggacgcaaccatttctgccctcagccccactttgccgtggggctgctgatctggagttacccagaacttctgacccctgggcctgaggagcctggagcaaagccctagctggctgcagagaatacaccttggctacaatgtccagcttggtctgggcttaggagcaagtcactgtaaaagaccttggctgcagcctccattcccccatccacccctccgtcctctcagggagcacagcccaccacccaccgcctactcagggctccctcctggcgcgctgagccccatttccactctccatctattttcaccctcagccttggagggctctggtgcttgcttctcctgagtcaggctctctcctcttgcttgctctcctccaaacctacctctcccaaagcccattttctgtgccacccagttttttccctaggagataaggctgtcagcctttagccaggccctggaggaatcagcaaaagccccaggctgggtattaacagttacgtcactggcaggagagtcccccgaaagcctatgggcagggcagcagaagggacttctgcaccagggccagactcccatttgtacagcagggagctgttcctgaggatccctgggcctctgtgacttggcttcagtttttacaagggctgttccccctggcccctcaggaaggctgtctccatctgcagttgggagaaataacctggacaatatgactgtcgtcccagggttccagcaccccaaggcctgcgggggatgtctcccagcactgcatggggtgtggtccttctcccaccagggaacaggaaaggaaacctggaagggaaaggctggcatttataacgtctgtaatttcattgccaacaatgttctcagtgtgtttggtatttgtgtgtccctgtgatggtctgagtcagtgctcctccagaaggagggggcaacccagccagcttctctaatgggaagaggtcttcactgccaggcacttaggaaagacctggagatggatcaggggagggcctactctcctgggcttgcagctgggctgtctgagtagccgacctggactgaggctccagagccatctgaggacaatttctcctgcttaattcagccctgtgaagcgtggagaagagtgtactaggggtgcggactcttgggtctttaagacccattcaagccaggcgcagtggctcacacctgtaatcccaaatattcaggaggctgaattgggagggtcctttgaacccaggggagttcgagaccagcctgggcaacatagcgagaccctatctctataaataaaaattcaaatcaacttcaaaaaatacccattcagctggatccctcactactctgccatttgccagctgtgagctctttttttttttttttttttgagacagagtgttgctctgtcacccaggctggagagcagtggcatgatctccacttactgcaagctctgcctcctgggttcacgccattctcctgcctcagcctcccgagtagctgggactacaggcgcccaccaccatgcccagctaattttttttgtatttttagtagagacagggtttcaccgtgttacccaggatggtctccatctcctgacctcgtgatccacccgcctcggcctcccaaagtgctgggattacaggcgtgagccactgcgcctgactgagctcttgaataagttatttcatctctcagccttgatttctttacctgttaaatggggtactcatagccgtaaaggatttttttgtgaagcctgatcgcaaagcatctggccctttccaaatgcttaatcaatatgtcattactattattaataaacattttctgagtgcctgcta

SEQ ID NO: 167679 - DNA, 2270 bp, Homo sapiens
  Payload ID: 12987
  Gene Symbol: GALNT16
  Gene Name: polypeptide N-acetylgalactosaminyltransferase 16
  Uniprot ID: Q8N428
  ENST ID: ENST00000448469
  CDS Start-End: 91-1767
aaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcatcaccttccacaatgaggcccgttccaccctgctgcgcacagtgaagagtgtcctgaaccgaactcctgccaacttgatccaggagatcattttagtggatgacttcagctcagatccggaagactgtctactcctgaccaggatccccaaggtcaagtgcctgcgcaatgatcggcgggaagggctgatccggtcccgagtgcgtggggcggacgtggctgcagctaccgttctcacctttctggatagccactgcgaagtgaacaccgagtggctgccgcccatgctgcagcgggtgaaggaggaccacacccgcgtggtgagtcccatcattgatgtcatcagtctggataattttgcctaccttgcagcatctgctgaccttcgtggagggttcgactggagcctgcatttcaagtgggagcagatccctcttgagcagaagatgacccggacagaccccaccaggcccataaggacgcctgtcatagctggaggaatcttcgtgatcgacaagtcctggtttaaccacttgggaaagtatgatgcccagatggacatctgggggggagagaattttgagctctccttcagggtgtggatgtgtggtggcagtctggagatcgtcccctgcagccgggtgggccatgtcttcaggaaacggcacccctacaacttccctgagggtaatgccctcacctacatcaggaatactaagcgcactgcagaagtgtggatggatgaatacaagcaatactactatgaggcccggccctcggccatcgggaaggccttcggcagtgtggctacgcggatagagcagaggaagaagatgaactgcaagtccttccgctggtacctggagaacgtctacccagagctcacggtccccgtgaaggaagcactccccggcatcattaagcagggggtgaactgcttagaatctcagggccagaacacagctggtgacttcctgcttggaatggggatctgcagagggtctgccaagaacccgcagcccgcccaggcatggctgttcagtgaccacctcatccagcagcaggggaagtgcctggctgccacctccaccttaatgtcctcccctggatccccagtcatactgcagatgtgcaaccctagagaaggcaagcagaaatggaggagaaaaggatctttcatccagcattcagtcagtggcctctgcctggagacaaagcctgcccagctggtgaccagcaagtgtcaggctgacgcccaggcccagcagtggcagctgttgccacacacatgacggtagccctggggcctcctgtaccttttgcatgagacttcgggaccggaagggggttagggtgggggagtgcaaagtgggctgttcccatctcctcacatttctgccaggaccatcagcaaatacccaccatgacacacgttctccaaagcttgttctaggagggcgcaggcgggcacgccccgatgccctcagtgctgtcctggccttgccccgggagaggagatggtcagggtgctggactgttgctgggtagagactgagtaggtgcccctggccctttgtcctctcccttggcgcttcttggggctgggacaatagtgtgtggtctctcccttgttgcccggagaaagcaaggacagaagcccacacaggggtcttttgggtcatgaggcccagctgtgcaggcaggcagggccaggggaaattgggcagcatggatggagaggctgaaggctgggaagagggaaggggagaggggcagcctgcaggggtagctgaag

SEQ ID NO: 167680 - DNA, 1629 bp, Homo sapiens
  Payload ID: 12987
  Gene Symbol: GALNT16
  Gene Name: polypeptide N-acetylgalactosaminyltransferase 16
  Uniprot ID: Q8N428
  ENST ID: ENST00000553669
  CDS Start-End: 1-1629
atgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcatcaccttccacaatgaggcccgttccaccctgctgcgcacagtgaagagtgtcctgaaccgaactcctgccaacttgatccaggagatcattttagtggatgacttcagctcagatccggaagactgtctactcctgaccaggatccccaaggtcaagtgcctgcgcaatgatcggcgggaagggctgatccggtcccgagtgcgtggggcggacgtggctgcagctaccgttctcacctttctggatagccactgcgaagtgaacaccgagtggctgccgcccatgctgcagcgggtgaaggaggaccacacccgcgtggtgagtcccatcattgatgtcatcagtctggataattttgcctaccttgcagcatctgctgaccttcgtggagggttcgactggagcctgcatttcaagtgggagcagatccctcttgagcagaagatgacccggacagaccccaccaggcccataaggacgcctgtcatagctggaggaatcttcgtgatcgacaagtcctggtttaaccacttgggaaagtatgatgcccagatggacatctgggggggagagaattttgagctctccttcagggtgtggatgtgtggtggcagtctggagatcgtcccctgcagccgggtgggccatgtcttcaggaaacggcacccctacaacttccctgagggtaatgccctcacctacatcaggaatactaagcgcactgcagaagtgtggatggatgaatacaagcaatactactatgaggcccggccctcggccatcgggaaggccttcggcagtgtggctacgcggatagagcagaggaagaagatgaactgcaagtccttccgctggtacctggagaacgtctacccagagctcacggtccccgtgaaggaagcactccccggcatcattaagcagggggtgaactgcttagaatctcagggccagaacacagctggtgacttcctgcttggaatggggatctgcagagggtctgccaagaacccgcagcccgcccaggcatggctgttcagtgaccacctcatccagcagcaggggaagtgcctggctgccacctccaccttaatgtcctcccctggatccccagtcatactgcagatgtgcaaccctagagaaggcaagcaggtgagtctccttgcctctggcccagaggcccagcagcccgaggggccatgcctcagggtggcagaccttggcaggagagcccctgattga

SEQ ID NO: 167681 - DNA, 5548 bp, Homo sapiens
  Payload ID: 12987
  Gene Symbol: GALNT16
  Gene Name: polypeptide N-acetylgalactosaminyltransferase 16
  Uniprot ID: Q8N428
  ENST ID: ENST00000553471
  CDS Start-End: 118-1746
gcaggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcatcaccttccacaatgaggcccgttccaccctgctgcgcacagtgaagagtgtcctgaaccgaactcctgccaacttgatccaggagatcattttagtggatgacttcagctcagatccggaagactgtctactcctgaccaggatccccaaggtcaagtgcctgcgcaatgatcggcgggaagggctgatccggtcccgagtgcgtggggcggacgtggctgcagctaccgttctcacctttctggatagccactgcgaagtgaacaccgagtggctgccgcccatgctgcagcgggtgaaggaggaccacacccgcgtggtgagtcccatcattgatgtcatcagtctggataattttgcctaccttgcagcatctgctgaccttcgtggagggttcgactggagcctgcatttcaagtgggagcagatccctcttgagcagaagatgacccggacagaccccaccaggcccataaggacgcctgtcatagctggaggaatcttcgtgatcgacaagtcctggtttaaccacttgggaaagtatgatgcccagatggacatctgggggggagagaattttgagctctccttcagggtgtggatgtgtggtggcagtctggagatcgtcccctgcagccgggtgggccatgtcttcaggaaacggcacccctacaacttccctgagggtaatgccctcacctacatcaggaatactaagcgcactgcagaagtgtggatggatgaatacaagcaatactactatgaggcccggccctcggccatcgggaaggccttcggcagtgtggctacgcggatagagcagaggaagaagatgaactgcaagtccttccgctggtacctggagaacgtctacccagagctcacggtccccgtgaaggaagcactccccggcatcattaagcagggggtgaactgcttagaatctcagggccagaacacagctggtgacttcctgcttggaatggggatctgcagagggtctgccaagaacccgcagcccgcccaggcatggctgttcagtgaccacctcatccagcagcaggggaagtgcctggctgccacctccaccttaatgtcctcccctggatccccagtcatactgcagatgtgcaaccctagagaaggcaagcaggtgagtctccttgcctctggcccagaggcccagcagcccgaggggccatgcctcagggtggcagaccttggcaggagagcccctgattgactcaaataagcccttcagagcgaggatctgtggggagggggagcaaagtctacatctaggtcaagccaattattctgcccatgaggaaatacttctttgggtaattatttgtttaatgccatcctgccaggctgtgagctccatgaaggcagggaccacttgtcttgttaacactgtatccctagctcctgacaaccaccacagttcaaataagtgttagcttttactgacagtctgtgctagaagtttgaaatagatcatctcatctaatcctcccagccacccagtgacgtgggttctagtactacctccattttataagtgagtaagctgaggctcgctgaatctaaagaatatatgtcagatcacacagctgagaaggggtggagctgggattcaaacccaggtcagtgacttctaggcccacagtcttaacccagcacatagtagatgttcaataagtatttcttgactgttggcagactagggaaactgagctccagacacagtgatgtccaagctggcatgaccagcctcacgtgagcactgctttttccattgatccgacactctcacccacactgtcaccactaatcctgggagacaggtcagggtcaaggaagaaagtgatgcacagagaggtggagtcacttgctcagggtacacagcaaccagtgacagtggatttccagaatccagccagctctcttctgtgctactcccttcctgtcttggagggctccctcaccacccagggaatgggacccaaggcccagaggctgctccagcacttcccctgctcaccctcctcagaagccctccctgtgcctgccactggctagcctgcctcagtcggtgcaagcagtgaggagggtgcctgggtctctgatttggcctgcatggttttcctcctacccctttttctttgcttgggtcagcacgttttttaaaggatgaacagcagtttgctgtgccattctggaaagcagccacagcctctccctccggcctgtgtgtgtctgagggatctgtgtgcccagcccacttgctggacctgtgggacactttaagcgcttttggatggtggggggatgcagcccaccctcggccctgccctgcagtggggctggtgcagtgtctcctgcacctagagcacccacctctctgagggcaaatccttgagcccacgcccaccccctcccactgaggaattatctccgagcaaagcctccactcaattgcccctctggggctgaatcacacatttccccctttgtgctgacccagcctacggggtgtgtaggtatctccttggccccattcattctgcccctgcaagtcctgccaggctcccgatggcattctgggtgcctgtgcccctcttctcccaggaggacaggatgagccagctatcccactgccaatgccttctggaatccgggccgtccttcttggtcccctgctggtcctatttccaaggctagctgggtttcctgtatccgagaggctcctgtgcctcagacctggtgtgatggagtcagcaggccccagctcagtcttccctccccctcccttcactcagtctcctcacttataaaataaggggctccctcccctgcttacctcacaaggaatccgcaagaaccaagatgtggagatgggacagtgggtgatgtgacattgtttctcagacaagcccagaattgagtggcctggagagtcaagaagccctgagattgtgcctaatagcactgataagaagtgagaatcccgctgtttggggagcacttcctaatgattgggtgattcagtcattcgttcatcttaaaacaaaatgacggctgggtgcagtggctcatgcctgtaatcccagcactttgggaggctgagatgggtggatcatgaggtcaggagttcgagaccagcctgaccaaaatggtgaaaccccgtctctactaaaaacacaaaaattagccgggcgtggtggcgcgcgtctgtaatcccagctactcaggaggctgagacaggagaatcgcttgaacccgggaggcagaggtagcagtgagccgagatcgtgtcactgcactcctgcctgggtgacagagcgagactcagtctcaaacaaacaaaatgtcactgggtgcctaccttgtgccagagaatgtacagatcatgttggccacaaggatgaacggacatggtccttgacccccagggaatttgcactttagtggaagagaaagaagggagtaagacactatattacagaaggctagatgctgaggtagctccaagcaccacgactccctggggtgaggatggccatactctctccagctgggcattgctggaggtttggcctacatgaggtaaatgtcaaggactagaagagcatgaagaaacaggaggggggatccaaaggcccttgacctttaggctctctgcgggggccatgtgggcccagagaggctgggtctcagccctacccatcacgtccttgcattcccactgggagcccaggctccgcccctgccttccaccctgtgtgcacatccccccgcagccctagccctatccctgcagctgggtgggctcatctctctcccctcagctgctccctgtccaccaactgccctcagagccctctgggcttcctccacatggtcacaagcactcctgcctctaatcgaagacacggtgaatgagagaagatggaagaggggaggtggttgcaatgggaggcaaataggagagaaacccaaactagacctatcttactattattcttccctgagccttgaaacctgggtctctgcctctcatcccttctcataaatgttccaagcaacactccatcctccacccaggcacttccgtaatgttctacaggagcaactcttctcccccttgtcaaacccggggtcggggaggcaccaggaggtgaaggcactgaccaggagcccctgcatgactctgtgatgcgagacctccagtctcccaccaccctgctggccccacacttcatccctacaaagaaggcagcttcccactagggggtgtagattactggcctcacaggtcagaagcttaggaagaataaatcttgtttacagaaataaaagatttacctaggccaggactgacaagctcaagtgcctacagggagctggtgggaaaaccccaataggagaaaagtcgggaccaggcaggaactatggtgacctgcagaacaagagccccatctaaggcagagggcaaatcctcagccccagcaactgatgccatgtaagaaactgggtccaataactacatagaagctggaaatgcagatttgcacgtggcaaccaagctaaattgtaaataaacacaggggacttctgctttgcctcctcctctgatctggacaggaacttctgcaaactacagaaaagcaagagccctgctgggaagggcagggcttaaagctggtgttagaggcaggatgggggcagcctcttacataggaacacacagcctgatttaaatgaggggcatgactgggcatggtagctcatgcctgtaatcccagtgctttggaaggccaagacaggtggatcacttgaggtgagacgttctagctagaccagcctgggcaacatagcaagacccaggctctgcacttatcagccggtcctttgtggcaacgcagccctgttctgtttttgcttttcctcttcttgaccaaagcatgtgccactagctgtccttgaggacctcgtctttatgaaacacacacctggaataaaaccacttcttacatgtc

SEQ ID NO: 167682 - DNA, 2504 bp, Homo sapiens
  Payload ID: 12988
  Gene Symbol: GALNT18
  Gene Name: polypeptide N-acetylgalactosaminyltransferase 18
  Uniprot ID: Q6P9A2
  ENST ID: ENST00000227756
  CDS Start-End: 413-2236
gctgttctcctagcagcgcgggccggtcggaccgccaaggcagccggcgctggcgatgggaagcggcgtggccgccgacacaggcagtggcaaagtttcccagacgtacacatctggacgcgcggctgccggctacccgtgacccctctaggaagggttcagggatttttaatttggaaaaaaatccacctggtttcctttgtcaaggtctctccgggtggccagcggcaggagctgcaaacttgggcacggcggctacaccggcagcggaccgggctttggagaacctcgggactcaggtgctgaggtgcccagcggctccggacgtgctacggggtgcgagcgcgggggagttcggggcgcacgacaaggaagggcccccgggagctctatatggaggaaggagcccagaatggtgtgcaccaggaagaccaaaactttggtgtccacttgcgtgatcctgagcggcatgactaacatcatctgcctgctctacgtgggctgggtcaccaactacatcgccagcgtgtatgtgcgggggcaggagccggcgcccgacaagaagctggaggaagacaaaggggacactctgaagattattgagcggctggaccacctggagaatgtcatcaagcagcacattcaagaggctcctgccaagcctgaggaggcagaggccgagcccttcacagactcctctctgtttgcacactggggccaggagctcagccccgaaggccggcgcgtggccctgaagcaattccagtactacggctacaacgcctacctcagcgaccgcctgcccctggaccggcccctgcctgacctcagacccagtgggtgccgtaacctctcatttcctgacagcctgccagaggtgagcatcgtgttcatcttcgtcaatgaagcgctttcagtgctgctgcgctccatccactcggccatggaacgcacgcccccacatctgctcaaggagatcattctggtggatgacaacagcagtaacgaggaactgaaggagaagctgaccgaatatgtggacaaggtgaacagccagaagccaggcttcatcaaagtcgtgcgtcacagcaagcaggaaggcctcatccgctccagggtcagtggctggagggcggccactgcccctgtggtggcactctttgatgcccacgtggagttcaatgtgggctgggctgaacctgtactcacccgcatcaaggagaaccggaagcggatcatctcgccatcctttgataacatcaaatatgacaactttgagatagaagagtacccgctggctgcccagggctttgactgggagctgtggtgccgctacctaaatccccccaaggcctggtggaagctggagaactccacagcgccaatcaggagccctgccctcattggctgcttcattgtggaccggcagtacttccaggagatcggcctgctggacgaaggcatggaagtctacgggggcgagaatgtggagcttgggatcagggtgtggcagtgtggcgggagtgtggaggtcctgccctgctcacggattgcccacattgagcgagcccacaagccctacacagaggacctcaccgcccatgtccgcaggaacgctctcagggtggctgaagtctggatggatgaatttaaaagccacgtctacatggcatggaacataccgcaggaggactcaggaattgacattggggacatcactgcaaggaaggctctcaggaaacagctgcagtgcaagaccttccggtggtacctggtcagcgtgtacccagagatgaggatgtactccgacatcattgcctatggagtgctgcagaattctctgaagactgatttgtgtcttgaccaggggccagatacagagaatgtccccatcatgtacatctgccatgggatgacgcctcagaacgtgtactacacgagcagtcagcagatccatgtgggcattctgagccccaccgtggatgatgatgacaaccgatgcctggtggacgtcaacagccggccccggctcatcgaatgcagctacgccaaagccaagaggatgaagcttcactggcagttctctcagggaggacccatccagaaccgcaagtctaagcgctgtctggagctgcaggagaatagcgacctggagttcggcttccagctggtgttgcagaagtgctcgggccagcactggagcatcaccaacgtcctgaggagcctcgcgtcctgacccaccggggccacttccggctgcctctttgctactgtgtagcacctgctgcaacgttgcctgctgtccacgtggggttgtttggagtctggggaaccaggttagtgggcccccaagaagagctttttatttcctattcaattttcatggagtttatagaaagatgctgattggtaggtgatggtatgatatcaaactattttgcagttgtaaataggggacagatggaaaatatttataactgacaataaaatattattaagaaaag

SEQ ID NO: 167683 - DNA, 4454 bp, Homo sapiens
  Payload ID: 12989
  Gene Symbol: GALNT2
  Gene Name: polypeptide N-acetylgalactosaminyltransferase 2
  Uniprot ID: Q10471
  ENST ID: ENST00000366672
  CDS Start-End: 73-1788
ccaccgcgcccgcggccggcccaggcagcactcgcgagcagcggcggccccgccggcggccgagttgggagaatgcggcggcgctcgcggatgctgctctgcttcgccttcctgtgggtgctgggcatcgcctactacatgtactcggggggcggctctgcgctggccgggggcgcgggcggcggcgccggcaggaaggaggactggaatgaaattgaccccattaaaaagaaagaccttcatcacagcaatggagaagagaaagcacaaagcatggagaccctccctccagggaaagtacggtggccagactttaaccaggaagcttatgttggagggacgatggtccgctccgggcaggacccttacgcccgcaacaagttcaaccaggtggagagtgataagcttcgaatggacagagccatccctgacacccggcatgaccagtgtcagcggaagcagtggcgggtggatctgccggccaccagcgtggtgatcacgtttcacaatgaagccaggtcggccctactcaggaccgtggtcagcgtgcttaagaaaagcccgccccatctcataaaagaaatcatcttggtggatgactacagcaatgatcctgaggacggggctctcttggggaaaattgagaaagtgcgagttcttagaaatgatcgacgagaaggcctcatgcgctcacgggttcggggggccgatgctgcccaagccaaggtcctgaccttcctggacagtcactgcgagtgtaatgagcactggctggagcccctcctggaaagggtggcggaggacaggactcgggttgtgtcacccatcatcgatgtcattaatatggacaactttcagtatgtgggggcatctgctgacttgaagggcggttttgattggaacttggtattcaagtgggattacatgacgcctgagcagagaaggtcccggcaggggaacccagtcgcccctataaaaacccccatgattgctggtgggctgtttgtgatggataagttctattttgaagaactggggaagtacgacatgatgatggatgtgtggggaggagagaacctagagatctcgttccgcgtgtggcagtgtggtggcagcctggagatcatcccgtgcagccgtgtgggacacgtgttccggaagcagcacccctacacgttcccgggtggcagtggcactgtctttgcccgaaacacccgccgggcagcagaggtctggatggatgaatacaaaaatttctattatgcagcagtgccttctgctagaaacgttccttatggaaatattcagagcagattggagcttaggaagaaactcagctgcaagcctttcaaatggtaccttgaaaatgtctatccagagttaagggttccagaccatcaggatatagcttttggggccttgcagcagggaactaactgcctcgacactttgggacactttgctgatggtgtggttggagtttatgaatgtcacaatgctgggggaaaccaggaatgggccttgacgaaggagaagtcggtgaagcacatggatttgtgccttactgtggtggaccgggcaccgggctctcttataaagctgcagggctgccgagaaaatgacagcagacagaaatgggaacagatcgagggcaactccaagctgaggcacgtgggcagcaacctgtgcctggacagtcgcacggccaagagcgggggcctaagcgtggaggtgtgtggcccggccctttcgcagcagtggaagttcacgctcaacctgcagcagtaggagggtccgggaggccctgccgtcctgtctcctgcaccattgggtggagtctggtgatcacattattgattatgtttcttaaactttccgcgaaactaatatacctcagtattccatcatggtctgaaagtcaaacttcggcaaggcacggacgactgtgcagacacagcagcggcaagaagcgagaactgccctccccctcctctcggtgcagcccagccgggcccccttccccaggccggagcgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaagaatgtacggtcagttccctatggtttctgtagatcatcgtcatcttgtatattccccacaaagccgttcgcagcttccgggagaaggggccagagcccggtggggccagtttctcacagagggaggaggtggcctttgtcccctggagcccgatcagccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaatataagacataccccatagctctgtgtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggctcacagtcctgcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttttaatcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagata

SEQ ID NO: 167684 - DNA, 3868 bp, Homo sapiens
  Payload ID: 12990
  Gene Symbol: GALNT3
  Gene Name: polypeptide N-acetylgalactosaminyltransferase 3
  Uniprot ID: Q14435
  ENST ID: ENST00000392701
  CDS Start-End: 777-2678
gctgaaccctgcccgaagaaaccacatgagccagcagttgctgccctcccgaagtggtcctcggaggcagcgcaccccttcattttggcgaaccgaggaggaagggaggaaccgtgtgggggaaatctagaacttctggttccccaaggacccagcagactgtgttctggctacaaggtgatcactgccaccaggtcagtgcaggattcctccaatgtagatgggccgggagccacaacttgcgcggagcagcagcctcgccgaccactcagagagaagccgcgcgacagccaggcttggcccggacggcgcccccaccctgcgcgcgcgatccaaggttctcacctggagcgctcaggtagggctggggcggggcgggaggctggcgcgcaggcgcggaagtggggcctcgcccctgccgacgtcgcaggctggagctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgccttcagtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtatttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttatttttttatctatgtggaaaacacaataaaaaatcctcaacactattgtaatcatttggttaagtttttttcctcttttgggtaaaatctgtaattgataataggtgggggaaaatgaattttgtatgctgaatttctaagcgcctattgtttgtaaaaccatcagatatttcttatggcacaaaaaatgaggaatagcaaaattcctgtgttcaatatttagaaaattttgtattaatttctgataaagttccttaagcatc

SEQ ID NO: 167685 - DNA, 2107 bp, Homo sapiens
  Payload ID: 12990
  Gene Symbol: GALNT3
  Gene Name: polypeptide N-acetylgalactosaminyltransferase 3
  ENST ID: ENST00000409882
  CDS Start-End: 14-1129
actgtaagtatatatgtatggatatggttgtaacattttccctccctctccctctaatttaaaaggtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgccttcagtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtatttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttatttttttatctatgtggaaaacacaataaaaaatcctcaacactattgtaa

SEQ ID NO: 167686 - DNA, 799 bp, Homo sapiens
  Payload ID: 12990
  Gene Symbol: GALNT3
  Gene Name: polypeptide N-acetylgalactosaminyltransferase 3
  ENST ID: ENST00000437849
  CDS Start-End: 1-270
gtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactcgttttcaactggcgattatagcaatgacagcccaagcaggtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagat

SEQ ID NO: 167687 - DNA, 540 bp, Homo sapiens
  Payload ID: 12990
  Gene Symbol: GALNT3
  Gene Name: polypeptide N-acetylgalactosaminyltransferase 3
  ENST ID: ENST00000431484
  CDS Start-End: 271-540
agcagttgctgccctcccgaagtggtcctcggaggcagcgcaccccttcattttggcgaaccgaggaggaagggaggaaccgtgtgggggaaatctagaacttctggttccccaaggacccagcagactgtgttctggctacaaggtgatcactgccaccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacatt

SEQ ID NO: 167688 - DNA, 570 bp, Homo sapiens
  Payload ID: 12990
  Gene Symbol: GALNT3
  Gene Name: polypeptide N-acetylgalactosaminyltransferase 3
  ENST ID: ENST00000447156
  CDS Start-End: 536-570
actggctatcgcggctcatagtatgtaatcgtttcctaaaaagtcctatttttcttttcctttgctcctgttgtcccatattagggtttaataaacttgctgtcctgttcttagggtcaattgcaagcaatattttatcaaaccaaattctgcttttttaactttatgacttctataggctccctacagacacttcaagtaaagctaatgaattctctttttactattagatcttgtatttctgtgagctattaaaactagctgttatataacaacaaattaaatgctgttgattttcttgtttttaggggttccttcaggagtcacaagtactattgggttggaaaatctgggagaataatagtttacttactgatgaaactgctgtattatcattcattaagctggagcagatcacagtttgagggtactaccattaaagataccttcttctcagcaaatctatgataaaaaatataagtaacagaagaagaaataactgttatttgtcaagtgacaagcttttaatgtcagaatggctcacctaaagcgactagtaaaattacacat

SEQ ID NO: 167689 - DNA, 1954 bp, Homo sapiens
  Payload ID: 12990
  Gene Symbol: GALNT3
  Gene Name: polypeptide N-acetylgalactosaminyltransferase 3
  ENST ID: ENST00000412248
  CDS Start-End: 563-1954
acatgagccagcagttgctgccctcccgaagtggtcctcggaggcagcgcaccccttcattttggcgaaccgaggaggaagggaggaaccgtgtgggggaaatctagaacttctggttccccaaggacccagcagactgtgttctggctacaaggtgatcactgccaccaggtcagtgcaggattcctccaatgtagatgggccgggagccacaacttgcgcggagcagcagcctcgccgaccactcagagagaagccgcgcgacagccaggcttggcccggacggcgcccccaccctgcgcgcgcgatccaaggttctcacctggagcgctcaggggttccttcaggagtcacaagtactattgggttggaaaatctgggagaataatagtttacttactgatgaaactgctgtattatcattcattaagctggagcagatcacagtttgagggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaa

SEQ ID NO: 167690 - DNA, 559 bp, Homo sapiens
  Payload ID: 12990
  Gene Symbol: GALNT3
  Gene Name: polypeptide N-acetylgalactosaminyltransferase 3
  ENST ID: ENST00000414977
  CDS Start-End: 388-559
agtgtgtcggttgcccctggagagatcccgaaaggggcgccctgggccaaggggcaggtggcgcctcgggggggagcccggtcacaccctctcgcccacggtgcccccgccagtccctatggggcggcccctgaggagctggacggagaccaaagacctggggttccttcaggagtcacaagtactattgggttggaaaatctgggagaataatagtttacttactgatgaaactgctgtattatcattcattaagctggagcagatcacagtttgagggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaa

SEQ ID NO: 167691 - DNA, 536 bp, Homo sapiens
  Payload ID: 12990
  Gene Symbol: GALNT3
  Gene Name: polypeptide N-acetylgalactosaminyltransferase 3
  ENST ID: ENST00000422973
  CDS Start-End: 461-536
agctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggggttccttcaggagtcacaagtactattgggttggaaaatctgggagaataatagtttacttactgatgaaactgctgtattatcattcattaagctggagcagatcacagtttgagggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcag

SEQ ID NO: 167692 - DNA, 5399 bp, Homo sapiens
  Payload ID: 12991
  Gene Symbol: GALNT4
  Gene Name: polypeptide N-acetylgalactosaminyltransferase 4
  Uniprot ID: Q8N4A0
  ENST ID: ENST00000529983
  CDS Start-End: 258-1994
gttggctggagagtttgtgaaaagttgtgagccgagcaggaggaagtagggagagaggagttgggctgtgccggaggccgaggaccgagagggctcaggtgacccctggaaagcctgggtggctggaaaggagcctagcgcctgcatgaaaggaagaacctgctgggaagtacctgagctcgagctgtgggttccgccgcccttcccctgcgtggtggcttggtggccgcgtctgcgcctcagccctgagaatccggatggcggtgaggtggacttgggcaggcaagagctgcctgctgctggcgtttttaacagtggcctatatcttcgtggagctcttggtctctacttttcatgcctccgcaggagccggccgtgccagggagctggggtcaagaaggctctcagacctccagaaaaatacggaggatttgtctcgaccgctttataagaagccccctgcagattcccgtgcacttggggagtgggggaaagccagcaaactccagctcaacgaggatgaactgaagcagcaagaagaactcattgagagatacgccatcaatatttacctcagtgacaggatttccctgcatcgacacatagaggataaaagaatgtatgagtgtaagtcccagaagttcaactataggacacttcctaccacctctgttatcattgctttctataacgaagcctggtcgactttgctccgtaccattcacagtgttttagaaacttctcctgcagttcttttgaaagagatcatcttggtggatgacttgagtgacagagtttatttgaagacacaacttgaaacttacatcagcaatcttgatagagtacgcttgattaggaccaataagcgagaggggctggttagggcccgtctgattggggccactttcgccactggggacgtcctcactttcctggattgtcactgtgagtgtaattccggttggctggaaccgcttttggaaaggattgggagagatgaaacagcagttgtgtgtcctgttatagacacaattgattggaatacttttgaattctatatgcagataggggagcccatgattggtgggtttgactggcgtttaacatttcagtggcattctgtccccaaacaggaaagggacaggcggatatcaagaattgaccccatcagatcacctaccatggctggaggactgtttgctgtcagcaagaaatattttcagtaccttggaacgtatgacacaggaatggaagtgtggggaggtgaaaaccttgagctgtcttttagggtgtggcagtgtggtggcaaattggagatccacccgtgttcccacgtgggccatgtgttccccaagcgggcaccatatgctcgccccaatttcctacagaatactgctcgggcagcagaagtttggatggatgaatacaaagagcacttctacaatagaaaccctccagcaagaaaagaagcttatggtgatatttctgaaagaaaattactacgagagcggttgagatgcaagagctttgactggtatttgaaaaacgtttttcctaatttacatgttccagaggatagaccaggctggcatggggctattcgcagtagagggatctcgtctgaatgtttagattataattctcctgacaacaaccccacaggtgctaacctttcactgtttggatgccatggtcaaggaggcaatcaattctttgaatatacttcaaacaaagaaataaggtttaattctgtgacagagttatgtgcagaggtacctgagcaaaaaaattatgtgggaatgcaaaattgtcccaaagatgggttccctgtaccagcaaacattatttggcattttaaagaagatggaactatttttcacccacactcaggactgtgtcttagtgcttatcggacaccggagggccgacctgatgtacaaatgagaacttgtgatgctctagataaaaatcaaatttggagttttgagaaatagagcacaacagcactttcgtcatgagctgacagtagtgtcaagaaagtcaaagagccttaagagcctcagtgaagattgtattttattttatcaaaagccacctagcagtcatctgtggagcactggaaagctggggttcattttggtatatcacactgaaactgggtacccagagtgctgctgtttaatatttcacaatgccttacttattggttgttttatataagagttttgtcaatatggtctcttcttaaaagaagttgactatgaattgaaacacacaaaacatttaagtgccagacttaatattaaagaatgtaaaggtccaagtaaaatgaggtatgatttatgttgatgtgtaagttcaccgcacatcccactttttaacaaaactcatgaatgtgcagtttgagccattgctattttgattacatagaatttgtatttcttttttagccagcacattaaattttagattttattttttaatctaatttttttctaatcaaaaagaaaattgagcttaaggcaaaaggcctggttttagagatatgtgtaattggaagagggcatttgtttgagtgtgagtttggaggcctttttaacatgcagacatacccatatttaaatgaaatggggagatatttacattccgtactttgtaaacttgagctattggacttcactgatgtatatattaatacctcagattcctctgattttgtaagctgtcttctctgtgaacgtgtttgtgtgtgtagggcattttctgattgcacttccttaagttatgaatgtactagaaagggactcatccagaatactatgcctccctttgttaatgcttaatcatttaaagtaaacacaattgaagcctctctgaagttaaacccaactatgtttattaaaatgtgtgaaactgaaagtgggctaggttctaccaaggctgtggaactctcctacgagttctgctgatcaggaaatttaagaatttatcttaaaaatgcaaggaaaaaagactgccttggcaattgtgaatggtgctttcaatctcctagcaccgagcctggcacttaggcagctttcagtaagtgggtgaatgaatgactgaatgaatgaatgaatggctcagctgaggaatgtaactttggtcaagttattatgatgtgtttgggcttagttttctcattggtaaaatgtgggtgctggattggatcttaaagatcccttccagctctgaaatgctgattgtacagtatattcttcccagattgactcactgtgcaatctttacaatactttttatcttttcacttttgacataggtaatgttgttgagcagttgagcaatgttcagtccagttgtgaagctggagaagagaaatgggttttaaaaattaagtgaggggaggccgggtgcggtggctcacgcatgtaatcccagcactttgggaggccaaggcaggtggatcacgaggtcaggagatccagaccatcctggctaacatggtgaaacctcgtctctactaaaaatacaaaaaattagccagctgtggtggcgggcgcctgtagtcccagctactcaggaggctgaggcaggagaatggcgtgaacctgtgaggcagagcttacagtgagccgagatcgtgccactgcactccagcctgggcgacagagcaagactctgtctcaaaaaaaaaaaataataataaaataagtgagctgaactcacctgaagtggtttacttctgtgggttaagaagttctagtcagtgttcatagtcgtttcgttttgataattgttgaaccaattttgtttttaaaacctttagactctgaaagtaatattttgactaagaatgtaaatatttccaaactaaattactcgggaagtaaacgctttttttaaaagtatttttactggttttataccaatattatatgcagaaatcacaggatgaatttagaattaaatctcaattagttcactttggcctagatttatgaaaaatgcatgcctcgtaaagagtccactgtattcacgagtaaagttgcttttagtgttcacttgatgacttggagagtaggaattttgcaaaatctgaatttaaggaaattctttaggataaccatttcaaaaaataaaattgctatgcaatcttgaatattttctcttttgcctcgtaaaatgaaaatgcattcacagtttctgtaaattatttagcagccttaaagtttatcaaaaaattgtccagattccacgtgcagcatgcttggccctgcatttaatttaagaaggattaataataatgctctgaatttttcgaaagggattctcctaaacccacccacttctcttgcccaggctgctttttaaaaatatttttttattttttacttatttttaaattttctctttttatttatttttggttttcttgttagccacctgttatatgggagaacgaaaattgttatattttgaaagtacttattacattatttttattttagtatcttgatgctcctgtcaaaagggaaatgaggcttttaaaaataaagtaccttaattctttattgactttttgccctaaattgctaggtgtgacccagcaatcttttaggaagagattttacagtggtgctttatttatatcaataatccagtatagttaggctgttcattcctcataatagagtacataacagaaaagtgggactttcacattttcatatttaggcacgttccaatttaattccaaaaatactctgtaattctacatctaaaaaaaccgattccctaattcgaatttattggtaccaaagctctctttggctatagacaattaagagttgaccttttaagttaatgtatatgcttaaaaacagttttaggaaaatatttggtagacaaagagtttcaactttaaatgttcactatgtcatttagtgtccaactttacggataggttgactatctaaataggcatttttagtcattaaaaaaaatctagtcaccaggaggatccctataactcaaaataacttgtttgtaaaagaaaatttgtttacttacccattagtaagttcctgcatattcattataagatggcaaatcaaacttttctaggatgaagacagcttatttttaagttgtatagtcttagttggtttagggtctcaattttaattaataaaatacttggtttttatttgcttgtccttttgaattcctgttttaataattttaaaatgagcacaaagaacgttgaagttcagattaatctcttctgaatgatgtttttttcctctgtgatgagttgtttctgacttttttccttttgtatttgtaatgttgattaagatgtaaaataaaaagtgtgcctgattatttttgcaaataga

SEQ ID NO: 167693 - DNA, 6171 bp, Homo sapiens
  Payload ID: 12992
  Gene Symbol: GALNT5
  Gene Name: polypeptide N-acetylgalactosaminyltransferase 5
  Uniprot ID: Q7Z7M9
  ENST ID: ENST00000259056
  CDS Start-End: 486-3308
gctgaatgaagttttctgggtaatggcatgaaatgttttccttatgagaagtggtgttgagttacagcgtgcagacggagaacggggaggagagaaacggcagtctcaatctggcccccaccttttcttgggcttgtaggaaggtggacatgggctcccggagacaagacaagtgatatgttgaactgttcggtggctggaatcaactgctcctggagtgacctaaggccagtgtttatcagaacttagccagggccagccaagcaggcacagatgctctgctatgaaatgccacgcaggcagagactgacaagcggtaggaactgagctttccccttggactgctgcttcctgctgtgttcaggggagggggtcactttctggcaactctgctgctgctgctgctgctgctgctacttcagcttcctctccactcaaggtaagcaggctaagggagggcaggctgctagggaaagctttgtaccatgaacaggatccgaaagtttttccgaggaagtgggcgagtcttggcatttatctttgtagcttctgtcatctggctcctctttgacatggcagctctccgcctctcattcagtgagatcaacactcgggtcatcaaggaagacattgtgaggagggagcggataggattcagagttcagccagaccaaggaaaaattttttacagcagcataaaagagatgaaacctcccctaaggggacatgggaaaggggcatggggcaaagagaatgttagaaaaactgaggagagtgtgctcaaggttgaggtggacttggaccaaacccagagggaaagaaaaatgcagaatgccctgggaaggggcaaggttgtgccgttgtggcatcctgcacatctgcagaccctccctgtgactcctaacaagcagaagacagacgggagaggcaccaaacctgaagcctcctctcaccaggggacaccaaagcaaacgacagctcagggggctccaaagacctcattcatagcagcaaaaggaactcaggtagtcaaaatatcagtacacatgggacgtgtcagtttaaaacaggagccccggaagagtcatagtcccagcagtgacacatcaaaactagcagctgaaagggacttgaatgtgaccatcagtcttagtactgatagaccaaagcagcgatcacaggcagtagcaaacgagagggcacaccctgccagcacagcagtgccgaagtctggggaagccatggccttaaacaaaactaagactcagagcaaagaagtcaatgcaaataaacacaaagccaatacgagtcttccttttcctaagttcactgtcaattcaaatcgcttaaggaagcaatctattaatgagacacctttgggaagtttgtcaaaggatgatggagctagaggggctcatgggaagaaactcaatttctctgaaagccatcttgtgattataaccaaagaggaagagcaaaaggcagaccccaaagaggtctctaattctaaaaccaaaacaatatttcctaaagtattgggtaaaagccaaagtaaacacatttccaggaatagaagtgagatgtcttcctcttcacttgctccacatagagtgccactgtcccaaactaaccatgctttaactggagggctagagccagcaaaaatcaacataactgccaaagccccctctacagaatacaaccagagtcatataaaagcccttttacctgaagacagtggaacgcaccaggtgttaagaattgatgtgacactttctccaagggaccccaaagctccagggcagtttgggcgtcctgtagttgtcccccatggaaaggagaaggaggcagaaagaagatggaaagaaggaaacttcaatgtctaccttagcgatttgatcccagtggatagagccattgaagacaccagacctgctggatgtgcagagcagctagttcacaataacctcccaaccaccagtgtcatcatgtgctttgtggatgaagtgtggtccactctcctgagatctgttcacagtgtcatcaatcgctctcctccacacctcatcaaggagattctgctggtagatgacttcagcaccaaagactatctaaaagataatttggataaatacatgtcccagtttccaaaagttcggattcttcgcctcaaagagagacatggcttaataagggccaggctggcaggagcacagaatgcaacaggtgatgtgttgacatttttagattctcatgtggaatgtaacgttggttggttggaacctcttctggaaagagtttatttaagtagaaagaaagtggcctgtccagtaatcgaagtcatcaatgataaggatatgagttacatgacagtggataactttcaaagaggcatctttgtgtggcccatgaactttggttggagaacaattcctccagatgtcattgcaaaaaacagaattaaagaaactgatacaataaggtgccctgtcatggctggtggattgttttctattgacaaaagttacttttttgaacttggaacatacgaccctggccttgatgtttggggtggggaaaatatggagctctcattcaaggtgtggatgtgtggtggtgaaattgagatcattccctgctcccgagtgggccatatattcagaaatgacaatccatattccttccccaaagaccggatgaagacagtggagcggaacttggtgcgggttgccgaggtctggctggatgagtataaggagctgttctatggccacggagaccacctcatcgaccaagggctagatgttggcaacctcacccagcaaagggagctgcgaaagaaactgaagtgcaaaagtttcaaatggtacttggagaatgtctttcctgacttaagggctcccattgtgagagctagtggtgtgcttattaatgtggctttgggtaaatgcatttccattgaaaacactacagtcattctggaagactgcgatgggagcaaagagcttcaacaatttaattacacctggttaagacttattaaatgtggagaatggtgtatagcccccatccctgataaaggagccgtaaggctgcacccttgtgataacagaaacaaagggctaaaatggctgcataaatcaacatcagtctttcatccagaactggtgaatcacattgtttttgaaaacaatcagcaattattatgcttggaaggaaatttttctcaaaagatcctgaaagtagctgcctgtgacccagtgaagccatatcaaaagtggaaatttgaaaaatattatgaagcctgaagtgtaactgatgtttttatatagtaaacccattaaatactgtgaaaataacactgaacttggaaactatatttctcagcggtagtttaaattttcaattttaataacatttgaatggaagattttttataaatcacaatatttggaataccaaaagatgactcaggaaaacagtccaacattggactgaagtccttcttcggaactgggtggcctttgaattgcctgctttccaccctatgctagacctcatcatgcaaatttccctgtgaaagctaacaggtaactggaaatgaagacagaaggacttgagaaagcatgaggatattcccaatgactatgtttggtaataatcagctcttctggcccacaagtaggaatgatcaatgagaacttaacttagtcctttatttggggattttttcatcaaacaaaaatttcttgagttcttatggctagaagacctcagatgcccacagctgtcacgtttgtgaaatccctccagactacatgcatgcttacctaacagtttgaaatagtattgatctactgctggtaaccctgcttgatggcagcattttgatctaaattacataatggtttttcccaatctgaatcagtggaaaaaaatttaagtgaggaagaagaggccttcaaatgcttatttaattctaggtatgaacactatttcagttcattttgtgcttttaaaactacagttttaaagatttatgataccaataacttcctagattcatgtggattttttttaaggcaatgaaaaaaggctggattataacacactgtagtaatcaaaaatgcatttaagcattgaatgcactctagtgcagggccaagtaagaggagttgaaatgagtaaagcagaaatagagctgctgaaagtttcttttatataaaaataataaaatactactttagatatagtagcattcacagggatgaaatatgcgaaaaatgggttctaaaatatttcaaagggaaaatgaagtgaaggaaacatcatgaaaggggaaaggaatgaggtaaacaagtcttaggaagagagttaagaaaaaattccgctggacttggccaaagaaagaaggggatctagtatctctatgaaggaaaaaagagtaaagccctcagtgtgaacccagtgagaacactgacaaatttgggaaaagttaaatactgatttcatccaaataaagcctctaatcttaagcataccaatactttggcataccagaagacaccttagaaatcaggatagcctttgcattcattttggtaagaaaactgatgctgagaggataaattacctaaaaatcttaaaacccaggcaagttagtcaaagaatcaagattagaattcaggtttccagagacagggctcattctaatgcctcaggtcactggcccgaacaaatctgcttcacagaattccttagaaagagatacacaattctttgctgggattgggtccctggaggacaaccatactatattcttgttaatatgttttttctttttttaaatttaaacttttgttcagttgagatgattgtgaaactaggtatctttcattctgactcctagtttaacatttaattttgactcccaatgagttacgtaaaagcaaaactataactaagaatgggaaaaagaactatttctgcacatttgtaacatatttaagatgttttcttcatataattgaaaactgcagatgagtaagagaatgactaggaaatgagatacagttatatgacacataatgatgttttagtcaacaatgaaccacatatttgacattggtcccaaaagattatattaataatatggtatctttagtgtgcttttctatgtttagacacacaaatactcaccatgatgttacaatagcctacagtgttcaatacagtaacatgcacaagtttgtaacctaggagcaacagggattccatatagcctaggtgtgtagtaggctacctacaccatctaggtttgtgtaagtacactctgatattcacacaatgatgaaattgcctaatgacacatttctcagaatgtatttgtgttattaaatgatgcatgactctaattcttttcaaaacagagccatatggggcaagggggatggggggacgcaagtcagttgtcaaaagactaattgagttactgacaaactgaacatgctaggtgcctcatgtaattcttcatgtaactaaaaaatgttgagaggtttttttcccccgggtatataggctctctttttatccgaaaatagtttccacaaagaagtcaactctgttctgaaaaaaaatgaattgcattttgaatacacttatctttgggtatatcaactaaaggaagttggatttttttccttaacagaaacttctgcagtcctctcagttcacatcctttctgactttaccctgacaaacttattatataaagctatatttaaatctatattgtcaatataacaaaggattgtttttgaacatcacaaatttgttcttggatagaattttatacattgcttttcatcatatatttgctcagttactctaagaagcaaggaactgatcactagttgggaatctatatgggcctaaacttgagtgtattgatttattattacatctactaccaacattttcttaagcatagccttctaaattttttcaggagattagaataaaggtatacatgctactcggtcttctggtaattctagtgataaacctttggatgagacaggtcctaatcagcactgaattcttcaataggaggctgtgttacaggagctacagatttttccctggattagcttaggtcattgcctttacttt

SEQ ID NO: 167694 - DNA, 2809 bp, Homo sapiens
  Payload ID: 12993
  Gene Symbol: GALNT6
  Gene Name: polypeptide N-acetylgalactosaminyltransferase 6
  Uniprot ID: Q8NCL4
  ENST ID: ENST00000356317
  CDS Start-End: 315-2183
ggtccctcctgccttcgctctctgctggtcgcggtggcctgtagctcctccctcggtaggacccccctccaccttggcgcttacgagatgaatgaggagcccagacctctggaacttggagggttgttcagattcccaggctgacaaaaaggagaaacagcttttacttgcatccagggccaatcatcgcagacccagacgtctgcagagggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctataagaagcactgtttcaatgcctttgccagcgaccggatctccctgcagaggtccctggggccagacacccgaccacctgagtgtgtggaccagaagttccggcgctgccccccactggccaccaccagcgtgatcattgtgttccacaacgaagcctggtccacactgctgcgaacagtgtacagcgtcctacacaccacccctgccatcttgctcaaggagatcatactggtggatgatgccagcacagaggagcacctaaaggagaagctggagcagtacgtgaagcagctgcaggtggtgagggtggtgcggcaggaggagcggaaggggctgatcaccgcccggctgctgggggccagcgtggcacaggcggaggtgctcacgttcctggatgcccactgtgagtgcttccacggctggctggagcccctcctggctcgaatcgctgaggacaagacagtggtggtgagcccagacatcgtcaccatcgaccttaatacttttgagttcgccaagcccgtccagaggggcagagtccatagccgaggcaactttgactggagcctgaccttcggctgggaaacacttcctccacatgagaagcagaggcgcaaggatgaaacctaccccatcaaatccccgacgtttgctggtggcctcttctccatctccaagtcctactttgagcacatcggtacctatgataatcagatggagatctggggaggggagaacgtggaaatgtccttccgggtgtggcagtgtgggggccagctggagatcatcccctgctctgtcgtaggccatgtgttccggaccaagagcccccacaccttccccaagggcactagtgtcattgctcgcaatcaagtgcgcctggcagaggtctggatggacagctacaagaagattttctataggagaaatctgcaggcagcaaagatggcccaagagaaatccttcggtgacatttcggaacgactgcagctgagggaacaactgcactgtcacaacttttcctggtacctgcacaatgtctacccagagatgtttgttcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaaggcaggaccttcctaatccttgcaacaacattgggcccattttctttccttcacaccgatggaagagaccattaggacatatatttagcctagcgttttcctgttctagaaatagaggctcccaaagtagggaaggcagctgggggagggttcagggcagcaatgctgagttcaagaaaagtacttcaggctgggcacagtggctcatgcctgaaatcctagcactttgggaagacaatgtgggagaatggcttgagcccaggagttcaagaccggcctgagcaacatagtgaggatcccatctctacgcccaccctccccccggcaaaaaaaaaaagctgggtatggtggcttatgcctgtagtcgcagctactcagaaggctgaggtgggaggattgcttgttccccggaggttgaagctacagtgagccttgattgtgtcactgcactccagcctgggcaacaggtaagactctgtctcaaaaaaaaacaaaaaa

SEQ ID NO: 167695 - DNA, 5207 bp, Homo sapiens
  Payload ID: 12993
  Gene Symbol: GALNT6
  Gene Name: polypeptide N-acetylgalactosaminyltransferase 6
  Uniprot ID: Q8NCL4
  ENST ID: ENST00000543196
  CDS Start-End: 207-2075
aacaggccctgctgtgagggaccacgaggcagtgccaggatgaaagagttggagtaacctaggtgattctgagtgaatcagtcaggaggccttcctggagggggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctataagaagcactgtttcaatgcctttgccagcgaccggatctccctgcagaggtccctggggccagacacccgaccacctgagtgtgtggaccagaagttccggcgctgccccccactggccaccaccagcgtgatcattgtgttccacaacgaagcctggtccacactgctgcgaacagtgtacagcgtcctacacaccacccctgccatcttgctcaaggagatcatactggtggatgatgccagcacagaggagcacctaaaggagaagctggagcagtacgtgaagcagctgcaggtggtgagggtggtgcggcaggaggagcggaaggggctgatcaccgcccggctgctgggggccagcgtggcacaggcggaggtgctcacgttcctggatgcccactgtgagtgcttccacggctggctggagcccctcctggctcgaatcgctgaggacaagacagtggtggtgagcccagacatcgtcaccatcgaccttaatacttttgagttcgccaagcccgtccagaggggcagagtccatagccgaggcaactttgactggagcctgaccttcggctgggaaacacttcctccacatgagaagcagaggcgcaaggatgaaacctaccccatcaaatccccgacgtttgctggtggcctcttctccatctccaagtcctactttgagcacatcggtacctatgataatcagatggagatctggggaggggagaacgtggaaatgtccttccgggtgtggcagtgtgggggccagctggagatcatcccctgctctgtcgtaggccatgtgttccggaccaagagcccccacaccttccccaagggcactagtgtcattgctcgcaatcaagtgcgcctggcagaggtctggatggacagctacaagaagattttctataggagaaatctgcaggcagcaaagatggcccaagagaaatccttcggtgacatttcggaacgactgcagctgagggaacaactgcactgtcacaacttttcctggtacctgcacaatgtctacccagagatgtttgttcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaaggcaggaccttcctaatccttgcaacaacattgggcccattttctttccttcacaccgatggaagagaccattaggacatatatttagcctagcgttttcctgttctagaaatagaggctcccaaagtagggaaggcagctgggggagggttcagggcagcaatgctgagttcaagaaaagtacttcaggctgggcacagtggctcatgcctgaaatcctagcactttgggaagacaatgtgggagaatggcttgagcccaggagttcaagaccggcctgagcaacatagtgaggatcccatctctacgcccaccctccccccggcaaaaaaaaaaagctgggtatggtggcttatgcctgtagtcgcagctactcagaaggctgaggtgggaggattgcttgttccccggaggttgaagctacagtgagccttgattgtgtcactgcactccagcctgggcaacaggtaagactctgtctcaaaaaaaaacaaaaaagaagaagaaaagtacttctacagccatgtcctattccttgatcatccaaagcacctgcagagtccagtgaaatgatatattctggctgggcacagtggctcacacctgtaatcctagcactttgggaggccaaggcaggtggatcacctgaggtcagaagtttgaaaccagcctggactacatggtgaaactccatctctactaaaagtacaaaaattagctgggcatgatggcacgcacctgcagtcccagctacttgggaggctgaggcaggagaatcactcgaacccaggaggcagaggttgcagtgagccaagacagcaccattgcaccccagcctgagcaacaagagcgaaactccatctcaggaaaaaaaaaaaaaaaaaaagtatattctaacagacagatcagaggtctaagagatcctcccttgctattattacctgaagtctgtagaactgtttacagatatctccttgacaggtgtcctttatcttactttatctgtacagtaatcctgtgagaaagacaggacagaaaccactgtgcctattttacagatacgaaaactgagacacaggtaaaggggcttgtctgtagtcccatagctagcagatggctggagccaagactgaggctcgttcttcaatgctgagccagggctccttccgctgcaccacaagaacgctagaccactcgccaccagccttctcattccctcttcctccattctaatcatttctagctggctggcctccacagagcataggaaaacagccagggccgggcacggtggctcatgcctgtaatctcaacactctgggaggccgagccgggtggataacctgaggtcaggaattcgagaccagcctggccaacatggtaaaaccccatctctactaaaaatataaaaattagccaggcatggtggcgcacacctgtaatcccagctactcaagaggctgaggcaggagaattgcttaaatctgggaggcggaagttgcagtgagccaagatcgcgccactgaactccagcctaggcaacaagagcaaaactccatctccaaaaaaaagaaaggaaaaacagggccaggtagccattgtggagagagcacacttaggaatcctgggatgttagtgttaaaagaaagctcctggagccagtgattctcaggtttgtcccagaacccttttttctaagccccatataaaaggtagattaaaaaaacaaagtagcatgagtgaaattgagagagggacaggtaatgccttccagcccctaacttctaacaatctggaagcacaacgtgaaaatcacgtagcccaaccctatcattttcatattatgaaactgagtccaggtaagtgaatctgtccaaggtcacccagcaaggtatcagtagccctgagggtaaggactctgataaggctcgggagggtcctggaaagcctgaggcggcaggaagagtgtgcagagttgagcgtgtctggaaggctgatccactgctgggcccacatcaaagcccccatggggagcagacccgactgcacatggctcttttgctggaagaagagcatggctgcgcagaggactaaaatttcatctgggaaggcttcttttgactgtcagtagcaggatgtcaccagatgagggtgctatgggaccacagctgtctttgttcccattgcaactcaaccctgcgggaggccgcctacatccctgagagccttctggagcctacagaggagacattggccagccaaaaggaaaggagtggccagggtacgacctggagtagggaagggaaaaagttcccggaaagaagagaattggatgagaggtctcagtggaaataaaggttttctggcattggtcaaggaaactcgcgttgtgttctcttacctgtgttgtcccttagctgaatcagttgatttgggctatgaagaaccacacacatctgaaaagttctgttacagccactgtctcatgtccccaaacattctctggccctaaatctagcttatgtattgtgtcaagcacgtggagacgtgagacgtcaaacgaggtcctgtccccgtggaactcacacgctaaatgtaagcaaatcatagcaagcctggagatgctccaagaggtgctggatgagttagaaggagcaattccttccacttagggaatcagataaggcctcacaaagatggcaatgtttgacctaagacctcggaagatgagtcctcagatgggaagggctcaataagcagagttgttacacaggcagcagcctggcaggagcaaagccacagaggacatgtggccccagtgggtctgagaaacccagaggacattggggtgagggagtgactggtgtagaagctggaagatcagagttacatcatgaatttcaggggccctaggcactttagccttcacggagctcttgctccattcaaaaaaaaattaatgttatgactatgttggtataaagatgaatgtaatccaggctga

SEQ ID NO: 167696 - DNA, 582 bp, Homo sapiens
  Payload ID: 12993
  Gene Symbol: GALNT6
  Gene Name: polypeptide N-acetylgalactosaminyltransferase 6
  ENST ID: ENST00000605617
  CDS Start-End: 377-582
gtccggtggggaaacccgggagccaccccgcggcgcggctgcggctttgcctcggcgcgacagttgttcagattcccaggctgacaaaaaggagaaacagcttttacttgcatccagggccaatcatcgcagacccagacgtctgcagaggggaaaataaaagaagcaaaaacaggccctgctgtgagggaccacgaggcagtgccaggatgaaagagttggagtaacctaggtgattctgagtgaatcagtcaggaggccttcctggagggggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcc

SEQ ID NO: 167697 - DNA, 538 bp, Homo sapiens
  Payload ID: 12993
  Gene Symbol: GALNT6
  Gene Name: polypeptide N-acetylgalactosaminyltransferase 6
  ENST ID: ENST00000604426
  CDS Start-End: 303-538
gttgctaaggccccaaaagattgcagcacacgaggcagcgccggagaggaccactgagcagcacgggccctggcgggggaaaataaaagaagcaaaaacaggccctgctgtgagggaccacgaggcagtgccaggatgaaagagttggagtaacctaggtgattctgagtgaatcagtcaggaggccttcctggagggggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagccca

SEQ ID NO: 167698 - DNA, 697 bp, Homo sapiens
  Payload ID: 12993
  Gene Symbol: GALNT6
  Gene Name: polypeptide N-acetylgalactosaminyltransferase 6
  ENST ID: ENST00000603563
  CDS Start-End: 532-697
ggaacttggaggggtgagagggggacaagccagagccagggctccacaccctcttcccctcacccacccatgccctgcattccttctgtgccccgtctccccagatcgggccaccccatgtgctctggtacggcaactcttgcagagaggtttcctcctgccctgccacgttgcgcctgagcagaaggggacagcaaggagaagcctcgctggtggagttgttcagattcccaggctgacaaaaaggagaaacagcttttacttgcatccagggccaatcatcgcagacccagacgtctgcagaggggaaaataaaagaagcaaaaacaggccctgctgtgagggaccacgaggcagtgccaggatgaaagagttggagtaacctaggtgattctgagtgaatcagtcaggaggccttcctggagggggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacc

SEQ ID NO: 167699 - DNA, 626 bp, Homo sapiens
  Payload ID: 12993
  Gene Symbol: GALNT6
  Gene Name: polypeptide N-acetylgalactosaminyltransferase 6
  ENST ID: ENST00000605138
  CDS Start-End: 509-626
gcggctgcggctttgcctcggcgcgacagttgttcagattcccaggctgacaaaaaggagaaacagcttttacttgcatccagggccaatcatcgcagacccagacgtctgcagaggggaaaataaaagaagcaaaaacaggccctgctgtgagggaccacgaggcagtgccaggatgaaagagttggagtaacctaggtgattctgaaccattgcaggtactgtgccttctgcctgaaatgtgctcacctcgcctcgctgactcctactcgccagttagtgttcggcccatttctgcccccgtgagatttcttcacagatgttgccctcccccatttgctgagtttcctgcatgccggctccttcagcactcaagggtacctctttgattctgcttctcacagggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagaga

SEQ ID NO: 167700 - DNA, 581 bp, Homo sapiens
  Payload ID: 12993
  Gene Symbol: GALNT6
  Gene Name: polypeptide N-acetylgalactosaminyltransferase 6
  ENST ID: ENST00000603188
  CDS Start-End: 394-581
taaaatgaaggggctgggccaggctggtccctcctgccttcgctctctgctggtcgcggtggcctgtagctcctccctcgttgttcagattcccaggctgacaaaaaggagaaacagcttttacttgcatccagggccaatcatcgcagacccagacgtctgcagaggggaaaataaaagaagcaaaaacaggccctgctgtgagggaccacgaggcagtgccaggatgaaagagttggagtaacctaggtgattctgagtgaatcagtcaggaggccttcctggagggggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaa

SEQ ID NO: 167701 - DNA, 567 bp, Homo sapiens
  Payload ID: 12993
  Gene Symbol: GALNT6
  Gene Name: polypeptide N-acetylgalactosaminyltransferase 6
  ENST ID: ENST00000604381
  CDS Start-End: 156-567
aaacccgggagccaccccgcggcgcggctgcggctttgcctcggcgcgacaggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctata

SEQ ID NO: 167702 - DNA, 574 bp, Homo sapiens
  Payload ID: 12993
  Gene Symbol: GALNT6
  Gene Name: polypeptide N-acetylgalactosaminyltransferase 6
  ENST ID: ENST00000604506
  CDS Start-End: 505-574
agtaaaatgaaggggctgggccaggctggtccctcctgccttcgctctctgctggtcgcggtggcctgtagctcctccctcgggaaaataaaagaagcaaaaacaggccctgctgtgagggaccacgaggcagtgccaggatgaaagagttggagtaacctaggtgattctgagtgaatcagtcaggaggccttcctggaggggaccattgcaggtactgtgccttctgcctgaaatgtgctcacctcgcctcgctgactcctactcgccagttagtgttcggcccatttctgcccccgtgagatttcttcacagatgttgccctcccccatttgctgagtttcctgcatgccggctccttcagcactcaagggtacctctttgattctgcttctcacagggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcc

SEQ ID NO: 167703 - DNA, 548 bp, Homo sapiens
  Payload ID: 12993
  Gene Symbol: GALNT6
  Gene Name: polypeptide N-acetylgalactosaminyltransferase 6
  ENST ID: ENST00000605055
  CDS Start-End: 480-548
aaacccgggagccaccccgcggcgcggctgcggctttgcctcggcgcgacagatcgggccaccccatgtgctctggtacggcaactcttgcagagaggtttcctcctgccctgccacgttgcgcctgagcagaaggggacagcaaggagaagcctcgctggtggagttgttcagattcccaggctgacaaaaaggagaaacagcttttacttgcatccagggccaatcatcgcagacccagacgtctgcagaggggaaaataaaagaagcaaaaacaggccctgctgtgagggaccacgaggcagtgccaggatgaaagagttggagtaacctaggtgattctgagtgaatcagtcaggaggccttcctggagggggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttc

SEQ ID NO: 167704 - DNA, 554 bp, Homo sapiens
  Payload ID: 12993
  Gene Symbol: GALNT6
  Gene Name: polypeptide N-acetylgalactosaminyltransferase 6
  ENST ID: ENST00000604847
  CDS Start-End: 186-554
agtaaaatgaaggggctgggccaggctggtccctcctgccttcgctctctgctggtcgcggtggcctgtagctcctccctcggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagc

SEQ ID NO: 167705 - DNA, 1859 bp, Homo sapiens
  Payload ID: 12993
  Gene Symbol: GALNT6
  Gene Name: polypeptide N-acetylgalactosaminyltransferase 6
  ENST ID: ENST00000603641
  CDS Start-End: 1-1098
atgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctataagaagcactgtttcaatgcctttgccagcgaccggatctccctgcagaggtccctggggccagacacccgaccacctgagtgtgtggaccagaagttccggcgctgccccccactggccaccaccagcgtgatcattgtgttccacaacgaagcctggtccacactgctgcgaacagtgtacagcgtcctacacaccacccctgccatcttgctcaaggagatcatactggtggatgatgccagcacagaggagcacctaaaggagaagctggagcagtacgtgaagcagctgcaggtggtgagggtggtgcggcaggaggagcggaaggggctgatcaccgcccggctgctgggggccagcgtggcacaggcggaggtgctcacgttcctggatgcccactgtgagtgcttccacggctggctggagcccctcctggctcgaatcgctgaggacaagacagtggtggtgagcccagacatcgtcaccatcgaccttaatacttttgagttcgccaagcccgtccagaggggcagagtccatagccgaggcaactttgactggagcctgaccttcggctgggaaacacttcctccacatgagaagcagaggcgcaaggatgaaacctaccccatcaagtgtggcagtgtgggggccagctggagatcatcccctgctctgtcgtaggccatgtgttccggaccaagagcccccacaccttccccaagggcactagtgtcattgctcgcaatcaagtgcgcctggcagaggtctggatggacagctacaagaagattttctataggagaaatctgcaggcagcaaagatggcccaagagaaatccttcggtgacatttcggaacgactgcagctgagggaacaactgcactgtcacaacttttcctggtacctgcacaatgtctacccagagatgtttgttcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggattt

SEQ ID NO: 167706 - DNA, 4307 bp, Homo sapiens
  Payload ID: 12994
  Gene Symbol: GALNT7
  Gene Name: polypeptide N-acetylgalactosaminyltransferase 7
  Uniprot ID: Q86SF2
  ENST ID: ENST00000265000
  CDS Start-End: 84-2057
agagccggaggagggggaaggagggaggggagagcggtggcggcggctgcgccgggctgtgagtctctcgccgccggaggaagatgaggctgaagattgggttcatcttacgcagtttgctggtggtgggaagcttcctggggctagtggtcctctggtcttccctgaccccgcggccggacgacccaagcccgctgagcaggatgagggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcagcgtcaatgacttacgccaagaagaatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaagaacacttaaaagaaaaactggatgaatatattaagctgtggaatggcctagtgaaggtatttcgaaatgaaagaagggaaggtttaattcaagcacgaagtattggtgctcagaaggctaaacttggacaggttttgatataccttgatgcccactgtgaggtggcagttaactggtatgcaccacttgtagctcccatatctaaggacagaaccatttgcactgtgccgcttatagatgtcataaatggcaacacatatgaaattataccccaagggggtggtgatgaagatgggtatgcccgaggagcatgggattggagtatgctctggaaacgggtgcctctgacccctcaagagaagagactgagaaagacaaaaactgaaccgtatcggtccccagccatggctgggggattatttgccattgaacgagagttcttctttgaattgggtctctatgatccaggtctccagatttggggtggtgaaaactttgagatctcatacaagatatggcagtgtggtggcaaattattatttgttccttgttctcgtgttggacatatctaccgtcttgagggctggcaaggaaatcctccgcccatttatgttgggtcttctccaactctgaagaattatgttagagttgtggaggtttggtgggatgaatataaagactacttctatgctagtcgtcctgaatcgcaggcattaccatatggggatatatcggagctgaaaaaatttcgagaagatcacaactgcaaaagttttaagtggttcatggaagaaatagcttatgatatcacctcacactaccctttgccacccaaaaatgttgactggggagaaatcagaggcttcgaaactgcttactgcattgatagcatgggaaaaacaaatggaggctttgttgaactaggaccctgccacaggatgggagggaatcagcttttcagaatcaatgaagcaaatcaactcatgcagtatgaccagtgtttgacaaagggagctgatggatcaaaagttatgattacacactgtaatctaaatgaatttaaggaatggcagtacttcaagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctgaaacctgctgcaactattgttattaactctgtatagctccaaacctggaacctcctgatcagtttgaaggacattgataaactgtgattttacaataacattatcatctgcagttactgtttacaagactgcttttaccttaaactttgtagatgtttacatctttttgttgtgttttaagatgatgttggtaatttgtgcctttagctctgttttattagacagagttaaagcatgttgtcttctttgggattacactcaggggtctgaaaggcagtttgatttttatttttaacacacttgaaaaaaggttggagtagccagactttcatatataacttggtgattatcaacctgttgtgtctttatttaattttacatctttttgaagcactgccacaggttattagccaaggtggccttccttcacagtcatgctgcttttttgaaaggtgaatttcaacacatttagtgcctctttcatttctcagtatatatttcaagagcttgtgatgaaatctataggatggtaatgatggacttgtcacctgtatggggaatacttttactactcagaaatgaatttatgtgctgccatttgctataaagttgaactttgtatggcttgaaaaagaaatgacaatatggaacatcccaaggctgtcccatagggttggaagttgtgtagcattcactcccttacctactggcattcccagtgccctctgtccatacctacttctaggattgcaaaggagtcttccaactagagaaaaattgtccactgacatttgggatttacttttctccaatacctgccaatacagaaaactattatcagttgttattgttatcccttgaaagcgagggtgacaaaaacaacaaaacaccgttataaacacatcaaaggttcattctgactgaggtaagactttccaagcccttgttagattaggccttataaaacttgtgtgcattataacctaagctgtgcaacctgtgaagccaagagtgaactgatgtttcatttatattttcatccaaatgacattatctgcacgtttttaaaatttaaaaacaaaggactatttaaaaatacagtttattaacaaacgtgaactactttctgttacattaggtgttccctagtgtttcttaatttctttttagaaagtgtatttttattagtatttttccggtgaacagaagatttgtttggatttaaacatttactaagacagtacctattaggaaaaccaaatattgcaaatggtcaattcgattttaatttctcaaaagatactctgttatccagaagattaaaatgcctacattgagtgcttaaaaaaaaaaaaacaactgtgatgatgtgagcagaatggcaagtaagttaagcatttttgatcctgtaatcatggtatcattacaatgaaaggaattcacaaactactgccagaggaagtttgttttttaatttaagagggaaatataacctataaatttgtttcttccaagcttagctcttaaatttggagactcaaagttaaacatcctcaacagagttttatttataattttgaattgtcaatttgtattttgctactgatctgtgatcaaccattttaactttcatctctagggatgtttaacatttataattgcaaaataaaccaactataaaaaaagaaactaagagagaattggtactttaattacttgtgtgtttgcaaataggctccattttccatgttgagtagattataaccttattaactatgcataggcctaagaaaggtggcaatgaactgtgcatgtaaattttaaatgggtactttgtgcaattcgttaaaagaagatactctatgaatatgattctatatattgaaatcagaaaacctaccaaacaaaaacatcagaagctgctgccataatgactattttctactgtaggctgctttggaaataattcccatatccttgctttgtaagttggtaatatcactatgcatttctacacattttataaatttgatttatgcagattttgatacactgtatgtttctgtagaaattgtataaatattcaaaattttattaggataaatttgagaaacttacgtatatcttaattctgggttgcttgttttttaggtgacaaaaataaaatattgtattttaattca

SEQ ID NO: 167707 - DNA, 1567 bp, Homo sapiens
  Payload ID: 12994
  Gene Symbol: GALNT7
  Gene Name: polypeptide N-acetylgalactosaminyltransferase 7
  ENST ID: ENST00000512285
  CDS Start-End: 26-1177
gtgagtctctcgccgccggaggaagatgaggctgaagattgggttcatcttacgcagtttgctggtggtgggaagcttcctggggctagtggtcctctggtcttccctgaccccgcggccggacgacccaagcccgctgagcaggatgagggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcagcgtcaatgacttacgccaagaagaatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaagaacacttaaaagaaaaactggatgaatatattaagctgtggaatggcctagtgaaggtatttcgaaatgaaagaagggaaggtttaattcaagcacgaagtattggtgctcagaaggctaaacttggacaggttttgatataccttgatgcccactgtgaggtggcagttaactggtatgcaccacttgtagctcccatatctaaggacagaactacatgtactgtgcctctaatagattacatagatgggaatgattattccattgaaccacagcaaggtggggatgaagatggttttgccagaggggcctgggactggagtttactatggaaacgtattcctctaagccacaaggaaaaggccaaaagaaaacataaaactgaaccttatcggtaaagactattactttattttcttatgttgaatgtttatctaagttcttttttttttcttccccatgaactcgtataaatgtgtgggtccatacatacgcttccatttgatctttgctgccatcaacacaatacagaaccatttgcactgtgccgcttatagatgtcataaatggcaacacatatgaaattataccccaagggggtggtgatgaagatgggtatgcccgaggagcatgggattggagtatgctctggaaacgggtgcctctgacccctcaagagaagagactgagaaagacaaaaactgaaccgtatcggtaatcactaaatcacttacatatttttcttttctccagttgctgctaacctattaacctcttgccaagctaaa

SEQ ID NO: 167708 - DNA, 1658 bp, Homo sapiens
  Payload ID: 12994
  Gene Symbol: GALNT7
  Gene Name: polypeptide N-acetylgalactosaminyltransferase 7
  ENST ID: ENST00000505308
  CDS Start-End: 1-1364
aaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaagaacacttaaaagaaaaactggatgaatatattaagctgtggaatggcctagtgaaggtatttcgaaatgaaagaagggaaggtttaattcaagcacgaagtattggtgctcagaaggctaaacttggacaggttttgatataccttgatgcccactgtgaggtggcagttaactggtatgcaccacttgtagctcccatatctaaggacagaactacatgtactgtgcctctaatagattacatagatgggaatgattattccattgaaccacagcaaggtggggatgaagatggttttgccagaggggcctgggactggagtttactatggaaacgtattcctctaagccacaaggaaaaggccaaaagaaaacataaaactgaaccttatcggtccccagccatggctgggggattatttgccattgaacgagagttcttctttgaattgggtctctatgatccaggtctccagatttggggtggtgaaaactttgagatctcatacaagatatggcagtgtggtggcaaattattatttgttccttgttctcgtgttggacatatctaccgtcttgagggctggcaaggaaatcctccgcccatttatgttgggtcttctccaactctgaagaattatgttagagttgtggaggtttggtgggatgaatataaagactacttctatgctagtcgtcctgaatcgcaggcattaccatatggggatatatcggagctgaaaaaatttcgagaagatcacaactgcaaaagttttaagtggttcatggaagaaatagcttatgatatcacctcacactaccctttgccacccaaaaatgttgactggggagaaatcagaggcttcgaaactgcttactgcattgatagcatgggaaaaacaaatggaggctttgttgaactaggaccctgccacaggatgggagggaatcagcttttcagaatcaatgaagcaaatcaactcatgcagtatgaccagtgtttgacaaagggagctgatggatcaaaagttatgattacacactgtaatctaaatgaatttaaggaatggcagtacttcaagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctgaaacctgctgcaactattgttattaactctgtatagctccaaacctggaacctcctgatcagtttgaaggacattgataaactgtgattttacaataacattatcatctgcagttactgtttacaagactgcttttaccttaaactttgtagatgtttacatctttttgttgtgttttaagatgatgttggtaatttgtgcctttagctctgttttattagacagag

SEQ ID NO: 167709 - DNA, 648 bp, Homo sapiens
  Payload ID: 12994
  Gene Symbol: GALNT7
  Gene Name: polypeptide N-acetylgalactosaminyltransferase 7
  ENST ID: ENST00000503213
  CDS Start-End: 1-598
attatttgttccttgttctcgtgttggacatatctaccgtcttgagggctggcaaggaaatcctccgcccatttatgttgggtcttctccaactctgaagaattatgttagagttgtggaggtttggtgggatgaatataaagactacttctatgctagtcgtcctgaatcgcaggcattaccatatggggatatatcggagctgaaaaaatttcgagaagatcacaactgcaaaagttttaagtggttcatggaagaaatagcttatgatatcacctcacactaccctttgccacccaaaaatgttgactggggagaaatcagaggcttcgaaactgcttactgcattgatagcatgggaaaaacaaatggaggctttgttgaactaggaccctgccacaggatgggagggaatcagcttttcagaatcaatgaagcaaatcaactcatgcagtatgaccagtgtttgacaaagggagctgatggatcaaaagttatgattacacactgtaatctaaatgaatttaaggaatggcagtacttcaaggtattctgcattttaacttctgaaatattatatgcttttcattttcagtaacatctagcatgtggaatttagataaataaatcttaaaacctgcattcaaa

SEQ ID NO: 167710 - DNA, 2380 bp, Homo sapiens
  Payload ID: 12995
  Gene Symbol: GALNT8
  Gene Name: polypeptide N-acetylgalactosaminyltransferase 8
  Uniprot ID: Q9NY28
  ENST ID: ENST00000252318
  CDS Start-End: 338-2251
gggagtgggtttcaggaggagccaagatgtttgattatactcctctgcttcaagggagtgttatctccctgagcaacctgtggaaagccgctgagcaacctgtggaaagccgctgagcggttatcctctcggggcataaagacaaagaaggcaataaggagactttgctcctcagaggccacccgtggcttcccatgggtgtctcacacaggggagaccaactcaactggcacctagaactctctttcccacaaaagctaggctggttctgattcttaacctgctccagcagtgacacactcagtcccacagggagtggacgacccccaggaagaagatgatgttttggaggaaactccccaaagccctcttcattgggctgactctggccattgctgtcaatctccttctggtattttctagcaaggggactttacaaaacctgtttacgggtggtctccacagggagcttcctttacatctgaataaacgctacggggcagtgataaagagactctcccacttggaggtggaattgcaggatctgaaagaaagtatgaaattagctctgaggcaacaagaaaatgtgaacagcacactgaagagggcgaaagatgaagtacgccctcttctaaaggcaatggaaaccaaggtgaatgagacaaagaagcacaaaacccaaatgaaactcttcccacactcacagcttttcaggcaatggggcgaggatctttctgaggcccagcagaaggcggcccaggacctcttccggaagtttggttacaacgcgtacctcagcaaccagctgcctctcaatcgcaccatccccgacacgcgagactacagatgtcttcggaagacatatccttcccaactcccatccctcagtgtcattctcatattcgtgaatgaagctctgtccattatacaacgggccatcaccagtatcatcaaccggacgccctctcgattgttgaaggaaatcatcttggtggatgatttcagctcaaatggagaactaaaggtacacttggatgagaagattaagctttacaaccagaagtatccaggactactgaaaataatacggcatcctgaaaggaaaggtcttgctcaagcccgcaacactggctgggaagctgccacagcagacgtggtcgccatcttggatgctcacattgaagtcaatgttgggtgggcagagccaatcttggctcggattcaggaggaccgcactgtgattgtgtctcctgtgtttgacaacattcgttttgacaccttcaaactggataagtatgaactggcagttgatgggtttaactgggaactctggtgccgctacgatgcactgccacaagcctggattgatctgcatgatgtcactgccccagtgaagagtccttcaatcatgggcatcctggctgctaacaggcacttcctgggagagatcgggtctctggatggtggaatgctcatctatggaggagagaacgtggagcttagcctgagggtgtggcagtgtggagggaaggtcgagattttgccctgttcccggattgcccacctagagagacaccacaagccctacgccttggatctcaccgctgccttgaagcgcaatgctctgcgagtggccgaaatctggatggatgagcacaaacacatggtctacttggcctggaacatacctctccagaactctggaatagattttggagacgtttcttccagaatggcactccgggaaaaactgaaatgtaaaacttttgactggtacctgaaaaatgtttatccactcttgaagccactccacaccatcgtgggctatggaagaatgaaaaacctattggatgaaaatgtctgcttggatcagggacccgttccaggcaacacccccatcatgtattactgccatgaattcagctcacagaatgtctactatcacctaactggggagctctatgtgggacaactgattgcagaggccagtgctagtgatcgctgcctgacagaccctggcaaggcggagaagcccaccttagaaccatgctccaaggcagctaagaatagactgcatatatattgggattttaaaccgggaggagctgtcataaacagagataccaagcggtgtctggagatgaagaaggatcttttgggtagccacgtgcttgtgctccagacctgtagcacgcaagtgtgggaaatccagcacactgtcagagactggggtcagaccaacagccagtgatcctcagatggtgctggatctgggtcatcaattcttgcaagtggaatggcttctactcctaacactcccagcttctttctcaatgagaaagaaagcatgtgtatgtctgtttatggcgacttcaggtgg

SEQ ID NO: 167711 - DNA, 5977 bp, Homo sapiens
  Payload ID: 12995
  Gene Symbol: GALNT8
  Gene Name: polypeptide N-acetylgalactosaminyltransferase 8
  ENST ID: ENST00000433855
  CDS Start-End: 867-2456
aagcttactggtgaggcaagtgtgcgtctatttccatggcgccctggctcgcggcagcccctggctgggcgaggggtgtgatgtgggagtggggtgggagggggcagcaggcggggcctgccacgtcacttggagagtgtgtgttgggaaggaagggcagagcggagagccgagccgctgcagctgcggcggcggcagcgaagccttgagccgtggggaggtgggtccccgcgctcgggcgccggggcagccccgggccctctgcgaggcctgcggcgcggctcctagggaggaggtggcggctgtggcggccggaaccgcgaccttggccggacccagccccgcggtggacgcagggcggaggccgagccccgccaggagtctttgccgagccggagggaggcgcatctggcgcttcggtaccagcggcagccgggggtccggagcggctggaggagcgcagtgggaactgggaagagctagcccggctggagggcggacctctgcgtccgggagccgggtctcaggcaccgctgggggcgaagccacgcgtcttttcgggcagccaatttcacacgcgcctgtgtgcggttccgggcatcccagtaagctctagcacccgggcgcgggtaacgggaagcgcagaaccaaatccccagcgcccaggtcacctccccagacccagccttgcagggaccagggctttagggctcacggacccaacggccaggtcagaccgcgaaccgggaggagcgcgggccccaccctaaagagggcgcagccgggagctggggagcgggtgccgcgctccagagattgtgtcgtgggcgccgtcctagtggcggggagcgcacctccgagggggcatgagatcggagaaatcccttacgctggcggcgccgggggaggtccgtgggccggagggagagcaacaggatgcgggagacttcccggaggccggcgggggcgggggctgctgtagtagcgagcggctggtgatcaatatctccgggctgcgctttgagacacaattgcgcaccctgtcgctgtttccggacacgctgctcggagaccctggccggcgagtccgcttcttcgaccccctgaggaacgagtacttcttcgaccgcaaccggcccagcttcgacgccatcctctactactaccagtctgggggccgcctgcggaggccggtcaacgtgcccctggacattttcctggaggagatccgcttctaccagctgggggacgaggccctggcggccttccgggaggacgagggctgcctgcccgaaggtggcgaggacgagaagccgctgccctcccagcccttccagcgccaggtgtggctgctctttgagtacccagagagctctgggccggccaggggcatcgccatcgtctccgtgttggtcattctcatctccatagtcatcttttgcctggagaccttaccccagttccgtgtagatggtcgaggtggaaacaatggtggtgtgagtcgagtctccccagtttccagggggagtcaggaggaagaggaggatgaagacgattcctacacatttcatcatggcatcacccctggggaaatggggaccgggggctcctcctcactcagtactcttgggggctccttctttacagaccccttctttctggtggagacgctgtgcattgtctggttcacttttgagctcctggtgcgcttctccgcctgccctagcaagccggccttcttccggaacatcatgaacatcattgacttggtggctatcttcccctacttcatcaccctgggcactgagctggtgcagcagcaggagcagcaaccagccagtggaggaggcggccagaatgggcagcaggccatgtccctggccatcctccgagtcatccgcctggtccgggtgttccgcatcttcaagctctcccgccactccaaggggctgcagatcctgggcaagaccttgcaggcctccatgagggagctggggctgctcatcttcttcctcttcatcggggtcatcctcttctccagtgccgtctacttcgcagaggctgacgatgacgattcgctttttcccagcatcccggatgccttctggtgggcagtggttacaatgaccacggtaggttacggggacatgtaccccatgactgtggggggaaagatcgtgggctcgctgtgtgccatcgctggggtcctcaccattgccctgcctgtgcccgtcatcgtctccaacttcaactacttctaccaccgggagacggagcaggaggagcaaggccagtatacccacgtcacttgtgggcagcctgcgccggacctgagggcaactgacaacggacttggcaagcctgacttccccgaggctaaccgggaacggagacccagctaccttcctacaccacatcgggcctatgcagagaaaagaatgctcacggaggtctgacccatgcaggcagggcctgcaggaggggagcactgagctaacagtctcttaggcttccttctcatttccactactcactctagcttcagttgacttcttgactctctcccctacacccactacctggcatccaggaccaaatacctggactatcaaccttgttgcttaatccctgcagcattcaaggttaatccatctaagtgacatttttgaaattccagcggtgccacccaatcatgcccagcttctgtcatatgaatgagatatacatttatgtctgaccttccctcaagactgatttttcatgtctgggacttacaatatctcaaggaacagcaatgtcaacaggatggaaaccagccctatctgagtcttcgctccctccttagtgttctttgctttgggtcatgtgcgtttcctagcttcaggctacttggtaactggaagaagctggaggacagaagcagtactcaacttgctgttattccagtgccctgtaacaatcactggtcctcctgcagatgacccttggtagagtctttatttgcatagcctcaaaataggttattcgtttctaaacttggatggaattagagaatacaatcaaactttaccacttggaggacacggggttagtccaggaccaaagaggccaatggatttttcaaagtgtgccccagcacaagaggcactggtgttcggtctacatttagttctccccactctgatcccctgactctccagcttccaggaaggttccttctcagagccaaatactctttgtgcaagtgccttcctgagcagaagaactggagaaagggaaccacagagccaggaggaatgtctgagcagagtcaagcaactggcttgaccacagtctgaagcaaggtgccacttaaacagatactgttttctcaaaggggcagaggaatcgtgttgcagatggcagccttttctccttcattttccccacattttctctggccctctaccttgcttcctgggagtttgatttaggattgctgttgaaggcttcctcaggcaaactccagcttaaagccctagacaggtaaaagcacacattggatggcagcatgggtttcttcccattttatgggcatgaaatatgtggtttagaataaggaacaagcattattcctttgccaacagcctcactctaagaggcttttttgctgagtcaagcaaacacttgcctgctctgccccttggagctgcatttgacctgctctcactggtaaggtgacttggtggcgttcccacttgatttagccattttcttccattgtgagaccactgccatctatccacctgcccacctccccttttgtttctcagtaacattgccatttgttttttgcctttgataaactgtgatgtactgttctgagatcttttgggtgcagttctgaaactgaaaggactgttaacatgtttttaattttatatctatgctttcagactctttgatgataattttttttttaaaaattattctctcgaagagcaacttacgagaggacagccttatgagggtttgcttgagaggcagtgtggcttctgtgactgccagctctaaatctcgatcttgccataactttacagggtaacttgggtccacagtcactctttgtgcctcagtttacccacccattaaatgggaacattactgtcttcccctccctacctcatggggaatgtctgggaagctggggacattgctatgcaaatgtgtgaatcttagtcatggatttgatttttagttatccccatacccccataggcaaggccttcccccagagttcctgctttggatccaaagcctgagaataggccattatggaccattggctccctaaatccctccttggcctcttggactgagcccctcagcctttcttcttacccttcagaaaggagagttctctttagatatgttcagggggatccttccatggctggaggtcaccttgactgggggcttggcttctccaaacctgaaacacagtagaagatagagatgtttatgatgcaaaaacctgctctgaggtcagaaagtgctagttttccaaatctctcccattgctgctggctatctggggaaagaagagaaaagcccattccagaggcagaagggaagctcccagccgagggtaaaagttgagacctgtatgcatgtatctctgtatatgtgtatgtaatcaccctcatcaccatccctgagaaaacattttcttttcaagtcagagcacgcctgaaagggtttgtggagagcccagctcaccagggactctggttgccgtagcaaccttccagactgttctctctatcttctgctttgggcatcaagggagaccaggggactacatcttcccagcttctcaaatgggagcacctcccacatcgtggcttaggggctgggagtgccagggcacggatgtgggacttttggaaaatgtggaggaagcagggcctcaaagcttcctgtctggacttttcttcctagtttccccacccagtcattgaagctgcctcatcttactcctgattcttcagaaatttgaatgttaagcaaccagttaaaccaacgtcagtattaattttttcaagctgtcgaggggagcccttagaggggacaacttcttggagtggcggccaagctgggccttaccaggtgtgatcatagtcttaggtatcatggagttcccatctccgcagaggcaggctcttcccagctccacgagaggcggagaattgcaacttcttcctctctgggaacggcctatctagctcctgggaggaatctcaaagatctttcttcttaagacatcgaagaaaaactgagaggctgtagctcgacctagtttctgtgaagaattttgtcaagtgatccctctcggaccctgagcctctttatttggattttgtgccttgagcaccaagagaatatgcactctgggttgcctggacagctggggtggtgattcacaggaagggtccaagccatcactacacctgactcaagccggaaagagctcccagaggacttcctggagctgccagcctcagcctgagatgcgggatattcgtccccaaggagcgaggagggacagctcgccttctttgcaggaaaaatgctggcaggtggtgcaagcaaggacatctatgcatagaattctgacagcagctggaccctcaacttcttcagaagacgagaaccctgcctggcaccgctggcaggcatctggcctgacaccgctctggaggcctcccacaagcagcaaccaagccagaaaaagttgagaccagacccgttgtccctaaagatggggcccagaatgttggggtgaagctgtaggaacagggtgaaagctggtggtgtgagcaaagagaccagctatggggtggtcaggggattccgggaggtgcatgggtatgttgcagacccccccaggacaagggtggctgtggaagaatggcaaataaacacaaggcaaagtctc

SEQ ID NO: 167712 - DNA, 577 bp, Homo sapiens
  Payload ID: 12995
  Gene Symbol: GALNT8
  Gene Name: polypeptide N-acetylgalactosaminyltransferase 8
  ENST ID: ENST00000542998
  CDS Start-End: 1-485
tttatccactcttgaagccactccacaccatcgtgggctatggaagaatgaaaaacctattggatgaaaatgtctgcttggatcagggacccgttccaggcaacacccccatcatgtattactgccatgaattcagctcacagaatgtctactatcacctaactggggagctctatgtgggacaactgattgcagaggccagtgctagtgatcgctgcctgacagaccctggcaaggcggagaagcccaccttagaaccatgctccaaggcagctaagaatagactgcatatatattgggattttaaaccggaaaaatgctggcaggtggtgcaagcaaggacatctatgcatagaattctgacagcagctggaccctcaacttcttcagaagacgagaaccctgcctggcaccgctggcaggcatctggcctgacaccgctctggaggcctcccacaagcagcaaccaagccagaaaaagttgagaccagacccgttgtccctaaagatggggcccagaatgttggggtgaagctgtaggaacagggtgaaagctggtggtgtgagcaaagagacc

SEQ ID NO: 167713 - DNA, 283 bp, Homo sapiens
  Payload ID: 12995
  Gene Symbol: GALNT8
  Gene Name: polypeptide N-acetylgalactosaminyltransferase 8
  ENST ID: ENST00000535354
  CDS Start-End: 1-266
atgaaaatgtctgcttggatcagggacccgttccaggcaacacccccatcatgtattactgccatgaattcagctcacagaatgtctactatcacctaactggggagctctatgtgggacaactgattgcagaggccagtgctagtgatcgctgcctgacagaccctggcaaggcggagaagcccaccttagaaccatgctccaaggcagctaagaatagactgcatatatattgggattttaaaccgcctaccattactaaataaataattatgcattccaa

SEQ ID NO: 167714 - DNA, 2410 bp, Homo sapiens
  Payload ID: 12996
  Gene Symbol: GALNT9
  Gene Name: polypeptide N-acetylgalactosaminyltransferase 9
  ENST ID: ENST00000328957
  CDS Start-End: 1-1812
atggcggtggccaggaagatccgaactttgctgacggtgaacatcctggtgttcgtgggcatcgtcctgttctccgtgtactgccgcctgcagggccgctcccaggagctcgtgcgcatcgtgagcggcgaccgccgggtgcgcagccgacacgccaaggtgggcacgctgggggaccgtgaggccatcctgcagcgcctggaccacctggaggaggtggtctacaaccagctcaacggccttgccaagcccatcggcctggtggaggggccaggaggcctgggccagggtggcttggcggccaccctgcgtgatgacggccaggaggcggaaggcaagtatgaggagtacggctacaacgctcagctcagcgaccgcatctccctcgatcggagcatccccgactaccggcccagaaagtgcagacagatgagctacgcccaggacctgccccaggtctccgtggtcttcatcttcgtcaatgaggcgctgtcggtcatcctgcgctccgtgcacagcgtggtcaaccacacgccctcccagctcctcaaggaggtcatcctggtggacgacaacagtgacaacgtggaactcaagttcaatctggaccagtacgtcaacaagcggtacccaggcctcgtgaagattgtccgcaacagccggcgggaaggactgatccgcgcgcggctgcagggctggaaggcggccaccgccccagtcgtcggcttctttgatgcccacgtcgagttcaacacgggctgggccgagcccgcactgtcgcggatccgagaggaccggcgtcgcatcgtgctgccagccatcgacaacatcaagtacagcacgtttgaggtgcagcagtatgcgaacgccgcccatggctacaactggggcctctggtgcatgtacatcatccccccgcaggactggctggaccgcggcgacgagtcagcacccatcaggaccccagccatgatcggctgctccttcgtagtggaccgcgagtacttcggagacattgggctgctggaccccggcatggaggtgtatggcggcgagaacgtagaactgggcatgagggtgtggcagtgtggcggcagcatggaggtgctgccctgctcccgcgtggcccacatcgagcgcaccaggaagccctacaacaacgacattgactactatgccaagcgcaacgccctgcgcgccgccgaggtgtggatggatgacttcaagtcccacgtgtacatggcctggaacatccccatgtcgaacccaggggtggacttcggggacgtgtctgagaggctggccctgcgtcagaggctgaagtgtcgcagcttcaagtggtacctggagaacgtgtacccggagatgagggtctacaacaacaccctcacgtacggagaggtgagaaacagcaaagccagtgcctactgtctggaccagggagcggaggacggcgaccgggcgatcctctacccctgccacgggatgtcctcccagctggtgcggtacagcgctgatggactgctgcagctggggcctctgggctccacagccttcttgcctgactccaagtgtctggtggatgacggcacgggccgcatgcccaccctgaagaagtgtgaggatgtggcgcggccaacacagcggctgtgggacttcacccagagtggccccattgtgagccgggccacgggccgctgcctggaggtggagatgtccaaagatgccaactttgggctccggctggtggtacagaggtgctcggggcagaagtggatgatcagaaactggatcaaacacgcacggcactgaccccacctccgcccggacccccacagacctcgggaaggcgctgggccgagccagtgtggctgagtgaccggggtgtgcccggcagacacagcaggacagggctctatgtgcggccaggacagcagaggctgaggggccggggtgtggctgagtgaccagggtgtcacccactgcatctggagtacagcttctcctaggacaggcggctctacccgagggagggcgtctggggacagtgatgccaactcaaacacgtgccttctccacggtatctcctggccaggctgctgggacagccgccgcctctgcatgtaccacagccccccacgccccatagggaggccaagccccggaccatgcaccaggctgcaccctggtgtcttccacccgcaggcctcccatgctccaagcagcctcccccagcacttgcggccgctcagccctccaaccaagacctaagtcacacatcataatgcagctccttgtggtctggtaagaggggtgctggaggacatggacagcgacaaacctgaggccgtgtctaggaggctggcacgactgcttcagcagagaccaaataaagagaggattaggcagc

SEQ ID NO: 167715 - DNA, 1727 bp, Homo sapiens
  Payload ID: 12996
  Gene Symbol: GALNT9
  Gene Name: polypeptide N-acetylgalactosaminyltransferase 9
  Uniprot ID: Q9HCQ5
  ENST ID: ENST00000397325
  CDS Start-End: 279-992
ggcgcttctgaagacgggtgggcagacgatggaggacgaggctctgtcccgcccctgcagagcttccttcgttccggccccttccagcgaagggcagggctccgagcagagacaacagacagaaacccagaaaccacctgccacgatgtgaacctgatgcagaaacgcggttcgctccctcgggatgcaaaggccaacttcagcctggcacggcggcgccgcggactccaccatcccggggaaggagccggacccctgtgtggcagtgtggcggcagcatggaggtgctgccctgctcccgcgtggcccacatcgagcgcaccaggaagccctacaacaacgacattgactactatgccaagcgcaacgccctgcgcgccgccgaggtgtggatggatgacttcaagtcccacgtgtacatggcctggaacatccccatgtcgaacccaggggtggacttcggggacgtgtctgagaggctggccctgcgtcagaggctgaagtgtcgcagcttcaagtggtacctggagaacgtgtacccggagatgagggtctacaacaacaccctcacgtacggagaggtgagaaacagcaaagccagtgcctactgtctggaccagggagcggaggacggcgaccgggcgatcctctacccctgccacgggatgtcctcccagctggtgcggtacagcgctgatggactgctgcagctggggcctctgggctccacagccttcttgcctgactccaagtgtctggtggatgacggcacgggccgcatgcccaccctgaagaagtgtgaggatgtggcgcggccaacacagcggctgtgggacttcacccagagtggccccattgtgagccgggccacgggccgctgcctggaggtggagatgtccaaagatgccaactttgggctccggctggtggtacagaggtgctcggggcagaagtggatgatcagaaactggatcaaacacgcacggcactgaccccacctccgcccggacccccacagacctcgggaaggcgctgggccgagccagtgtggctgagtgaccggggtgtgcccggcagacacagcaggacagggctctatgtgcggccaggacagcagaggctgaggggccggggtgtggctgagtgaccagggtgtcacccactgcatctggagtacagcttctcctaggacaggcggctctacccgagggagggcgtctggggacagtgatgccaactcaaacacgtgccttctccacggtatctcctggccaggctgctgggacagccgccgcctctgcatgtaccacagccccccacgccccatagggaggccaagccccggaccatgcaccaggctgcaccctggtgtcttccacccgcaggcctcccatgctccaagcagcctcccccagcacttgcggccgctcagccctccaaccaagacctaagtcacacatcataatgcagctccttgtggtctggtaagaggggtgctggaggacatggacagcgacaaacctgaggccgtgtctaggaggctggcacgactgcttcagcagagaccaaataaagagaggattaggcagcagcactgtgtgtgtcttcctgggagccgagctgggggttggggcccggtcccacctctttcccaggcacctgggccctgccgcagcccagccccttgcctgttttaataaatacagttttattggcgcccagccaca

SEQ ID NO: 167716 - DNA, 1727 bp, Homo sapiens
  Payload ID: 12996
  Gene Symbol: GALNT9
  Gene Name: polypeptide N-acetylgalactosaminyltransferase 9
  ENST ID: ENST00000411988
  CDS Start-End: 1-1129
catcatccccccgcaggactggctggaccgcggcgacgagtcagcacccatcaggaccccagccatgatcggctgctccttcgtagtggaccgcgagtacttcggagacattgggctgctggaccccggcatggaggtgtatggcggcgagaacgtagaactgggcatgagggaaacagaagggttccagcaagataaggtaaattataaacagaataaaagaggaagaaaaacacggcagagagtgaagaggagcaggtccgaggcccatagagcacagccgagccccggggccacgcacggagcccacagccgagccccggggccacgcacggagcccacagctgagccctggggccacgccaggcccacagcagcactgccagcgactggagtgtggcagtgtggcggcagcatggaggtgctgccctgctcccgcgtggcccacatcgagcgcaccaggaagccctacaacaacgacattgactactatgccaagcgcaacgccctgcgcgccgccgaggtgtggatggatgacttcaagtcccacgtgtacatggcctggaacatccccatgtcgaacccaggggtggacttcggggacgtgtctgagaggctggccctgcgtcagaggctgaagtgtcgcagcttcaagtggtacctggagaacgtgtacccggagatgagggtctacaacaacaccctcacgtacggagaggtgagaaacagcaaagccagtgcctactgtctggaccagggagcggaggacggcgaccgggcgatcctctacccctgccacgggatgtcctcccagctggtgcggtacagcgctgatggactgctgcagctggggcctctgggctccacagccttcttgcctgactccaagtgtctggtggatgacggcacgggccgcatgcccaccctgaagaagtgtgaggatgtggcgcggccaacacagcggctgtgggacttcacccagagtggccccattgtgagccgggccacgggccgctgcctggaggtggagatgtccaaagatgccaactttgggctccggctggtggtacagaggtgctcggggcagaagtggatgatcagaaactggatcaaacacgcacggcactgaccccacctccgcccggacccccacagacctcgggaaggcgctgggccgagccagtgtggctgagtgaccggggtgtgcccggcagacacagcaggacagggctctatgtgcggccaggacagcagaggctgaggggccggggtgtggctgagtgaccagggtgtcacccactgcatctggagtacagcttctcctaggacaggcggctctacccgagggagggcgtctggggacagtgatgccaactcaaacacgtgccttctccacggtatctcctggccaggctgctgggacagccgccgcctctgcatgtaccacagccccccacgccccatagggaggccaagccccggaccatgcaccaggctgcaccctggtgtcttccacccgcaggcctcccatgctccaagcagcctcccccagcacttgcggccgctcagccctccaaccaagacctaagtcacacatcataatgcagctccttgtggtctggtaagaggggtgctggaggacatggacagcgacaaacctgaggccgtgtctaggaggctggcacgactgcttcagcagagaccaaataaagagaggattaggcagc

SEQ ID NO: 167717 - DNA, 624 bp, Homo sapiens
  Payload ID: 12996
  Gene Symbol: GALNT9
  Gene Name: polypeptide N-acetylgalactosaminyltransferase 9
  ENST ID: ENST00000542942
  CDS Start-End: 462-624
aaatcccgaccctagtctggaaggcagaaaggaagccccggctcagggggctggaaaaccccaggcttttctcaggcaggttgtcccacagcagagacaacagacagaaacccagaaaccacctgccacgatgtgaacctgatgcagaaacgcggttcgctccctcgggatgcaaaggccaacttcagcctggcacggcggcgccgcggactccaccatcccggggaaggagccggacccctgtgggtgacgtgggactgtggggcgggggtgtccccggctgggctgagctgagcagcgaggaggctctgggttgccggaccggggtcagggagcctggcgttagctgcgtgctgtgtggtcatctcggcgaggagggagcggctccctcctgccccggactctggatctgtcctgcggtgggcggtgtcggagcagccgtgtggcagtgtggcggcagcatggaggtgctgccctgctcccgcgtggcccacatcgagcgcaccaggaagccctacaacaacgacattgactactatgccaagcgcaacgccctgcgcgccgccgaggtgtggatggatgacttcaagtcccacgtgtacatggcctggaacatccccatgt

SEQ ID NO: 167718 - DNA, 1001 bp, Homo sapiens
  Payload ID: 12996
  Gene Symbol: GALNT9
  Gene Name: polypeptide N-acetylgalactosaminyltransferase 9
  Uniprot ID: Q9HCQ5
  ENST ID: ENST00000541995
  CDS Start-End: 254-967
cctagtctggaaggcagaaaggaagccccggctcagggggctggaaaaccccaggcttttctcaggcaggttgtcccacagcagagacaacagacagaaacccagaaaccacctgccacgatgtgaacctgatgcagaaacgcggttcgctccctcgggatgcaaaggccaacttcagcctggcacggcggcgccgcggactccaccatcccggggaaggagccggacccctgtgtggcagtgtggcggcagcatggaggtgctgccctgctcccgcgtggcccacatcgagcgcaccaggaagccctacaacaacgacattgactactatgccaagcgcaacgccctgcgcgccgccgaggtgtggatggatgacttcaagtcccacgtgtacatggcctggaacatccccatgtcgaacccaggggtggacttcggggacgtgtctgagaggctggccctgcgtcagaggctgaagtgtcgcagcttcaagtggtacctggagaacgtgtacccggagatgagggtctacaacaacaccctcacgtacggagaggtgagaaacagcaaagccagtgcctactgtctggaccagggagcggaggacggcgaccgggcgatcctctacccctgccacgggatgtcctcccagctggtgcggtacagcgctgatggactgctgcagctggggcctctgggctccacagccttcttgcctgactccaagtgtctggtggatgacggcacgggccgcatgcccaccctgaagaagtgtgaggatgtggcgcggccaacacagcggctgtgggacttcacccagagtggccccattgtgagccgggccacgggccgctgcctggaggtggagatgtccaaagatgccaactttgggctccggctggtggtacagaggtgctcggggcagaagtggatgatcagaaactggatcaaacacgcacggcactgaccccacctccgcccggacccccacagacctcggg

SEQ ID NO: 167719 - DNA, 897 bp, Homo sapiens
  Payload ID: 12996
  Gene Symbol: GALNT9
  Gene Name: polypeptide N-acetylgalactosaminyltransferase 9
  ENST ID: ENST00000538356
  CDS Start-End: 608-897
gtgttccccagcgtgaggcccgaggacaggattctgtggtgggtggggggaccgagtcaccgtggcctctgtactgggggtagacaaggaggctgaaactgctggaggtcgtcccagaggccagtgtgccaggcgcttctgaagacgggtgggcagacgatggaggacgaggctctgtcccgcccctgcagagcttccttcgttccggccccttccagcgaagggcagggctccgagcagagacaacagacagaaacccagaaaccacctgccacgatgtgaacctgatgcagaaacgcggttcgctccctcgggatgcaaaggccaacttcagcctggcacggcggcgccgcggactccaccatcccggggaaggagccggacccctgtgggtgacgtgggactgtggggcgggggtgtccccggctgggctgagctgagcagcgaggaggctctgggttgccggaccggggtcagggagcctggcgttagctgcgtgctgtgtggtcatctcggcgaggagggagcggctccctcctgccccggactctggatctgtcctgcggtgggcggtgtcggagcagccgtgtggcagtgtggcggcagcatggaggtgctgccctgctcccgcgtggcccacatcgagcgcaccaggaagccctacaacaacgacattgactactatgccaagcgcaacgccctgcgcgccgccgaggtgtggatggatgacttcaagtcccacgtgtacatggcctggaacatccccatgtcgaacccaggggtggacttcggggacgtgtctgagaggctggccctgcgtcagaggctgaagtgtcgcagcttcaagtggtacctggagaacgtgtacccggagatgagggtctacaacaacaccct

SEQ ID NO: 167720 - DNA, 1719 bp, Homo sapiens
  Payload ID: 12997
  Gene Symbol: GALNTL5
  Gene Name: polypeptide N-acetylgalactosaminyltransferase-like 5
  Uniprot ID: Q7Z4T8
  ENST ID: ENST00000392800
  CDS Start-End: 255-1586
gtgagggggactgtactgccctttgagtactactgtgtggccccgcaacccagcacaaccaggtatctgcttggaacccagccaccataaagcctgctagctaaaaaaaattttacatctctcagttcattcggcacagacccctgcctcattcagctgtgactctgcttggaaaattcatcagttacaaagcagccaatgcaattatctcaagggaaattgaaaaatggacctttgaaaatgctagatttacaatgagaaatgccataattcaaggtttattctatgggtccttgacatttgggatctggacagctctgttattcatatatttgcaccataatcatgtgagcagctggcagaagaaaagccaggagcctctgtcagcttggtcccctggaaaaaaagtgcatcagcaaattatctatggctcagagcaaataccaaaacctcatgtaatagtcaaaaggactgatgaagataaagcaaagtctatgttaggtacagattttaaccatacaaacccagaacttcataaagaacttttaaaatatggatttaatgtgattatcagtagaagcttgggcatcgaaagagaagtgccagataccaggagtaaaatgtgtcttcaaaaacattacccagcccgcctcccgactgccagcattgtcatttgcttctataatgaagaatgtaatgccttgtttcagaccatgtccagtgtcacgaacctcacgccacactattttcttgaagaaattattttggtagatgacatgagcaaagttgatgatttgaaagaaaaactagactatcacctggaaacttttcggggaaaggttaaaataataagaaacaaaaagagagaggggctgattcgagcaaggctgattggagcttctcatgcttcaggggatgttctggtgttcctggacagccactgtgaggtgaacagagtatggctggagcccctgctgcatgccattgccaaggaccccaaaatggtggtgtgccccctgatagatgtcattgatgatagaactctggagtataagccctctcctcttgtaaggggaacttttgattggaacctacaatttaaatgggataatgttttctcttatgagatggatggaccagaaggatctactaaaccaatccggtcacctgcaatgtctggaggaatttttgctatacgtcggcattattttaatgaaattggacagtatgacaaggatatggatttttggggaagagaaaatttggaactttcactaaggatctggatgtgtggaggccaactctttataatcccctgctctcgagtaggacatatcagtaagaaacaaactggaaaaccttctacaatcatcagtgctatgacacataactacctaagactggtgcacgtttggctggatgaatataaggagcagttttttcttcgaaagcctggtctgaaatatgtcacctacggaaatattcgcgagcgtgttgagttaaggaaacgactgggttgcaagtcatttcagtggtatttggataatgtcttcccagagttggaggcatctgtgaacagcctgtgaaaggaaaacaaatcactttcattaataaagggttaaaagtctcctagtcattcaacatagtgtcacaagagtgtaagtttggaacatcgtggaattacgtgaaatgcaattaaaaaaatatgaccagacgtga

SEQ ID NO: 167721 - DNA, 1678 bp, Homo sapiens
  Payload ID: 12997
  Gene Symbol: GALNTL5
  Gene Name: polypeptide N-acetylgalactosaminyltransferase-like 5
  Uniprot ID: Q7Z4T8
  ENST ID: ENST00000431418
  CDS Start-End: 222-1553
gatgtcatcaggctttgtgagggggactgtactgccctttgagtactactgtgtggccccgcaacccagcacaaccagcattgaattctgcatcttttagtgaagaaaataactgaacatggttttcttctgaagacacaaagtccaaaggccaatcacacacctcttacatcgatctcttggaaattgaaaaatggacctttgaaaatgctagatttacaatgagaaatgccataattcaaggtttattctatgggtccttgacatttgggatctggacagctctgttattcatatatttgcaccataatcatgtgagcagctggcagaagaaaagccaggagcctctgtcagcttggtcccctggaaaaaaagtgcatcagcaaattatctatggctcagagcaaataccaaaacctcatgtaatagtcaaaaggactgatgaagataaagcaaagtctatgttaggtacagattttaaccatacaaacccagaacttcataaagaacttttaaaatatggatttaatgtgattatcagtagaagcttgggcatcgaaagagaagtgccagataccaggagtaaaatgtgtcttcaaaaacattacccagcccgcctcccgactgccagcattgtcatttgcttctataatgaagaatgtaatgccttgtttcagaccatgtccagtgtcacgaacctcacgccacactattttcttgaagaaattattttggtagatgacatgagcaaagttgatgatttgaaagaaaaactagactatcacctggaaacttttcggggaaaggttaaaataataagaaacaaaaagagagaggggctgattcgagcaaggctgattggagcttctcatgcttcaggggatgttctggtgttcctggacagccactgtgaggtgaacagagtatggctggagcccctgctgcatgccattgccaaggaccccaaaatggtggtgtgccccctgatagatgtcattgatgatagaactctggagtataagccctctcctcttgtaaggggaacttttgattggaacctacaatttaaatgggataatgttttctcttatgagatggatggaccagaaggatctactaaaccaatccggtcacctgcaatgtctggaggaatttttgctatacgtcggcattattttaatgaaattggacagtatgacaaggatatggatttttggggaagagaaaatttggaactttcactaaggatctggatgtgtggaggccaactctttataatcccctgctctcgagtaggacatatcagtaagaaacaaactggaaaaccttctacaatcatcagtgctatgacacataactacctaagactggtgcacgtttggctggatgaatataaggagcagttttttcttcgaaagcctggtctgaaatatgtcacctacggaaatattcgcgagcgtgttgagttaaggaaacgactgggttgcaagtcatttcagtggtatttggataatgtcttcccagagttggaggcatctgtgaacagcctgtgaaaggaaaacaaatcactttcattaataaagggttaaaagtctcctagtcattcaacatagtgtcacaagagtgtaagtttggaacatcgtggaattacgtgaaatgcaattaaaaaaatatgacc

SEQ ID NO: 167722 - DNA, 2272 bp, Homo sapiens
  Payload ID: 12997
  Gene Symbol: GALNTL5
  Gene Name: polypeptide N-acetylgalactosaminyltransferase-like 5
  ENST ID: ENST00000416269
  CDS Start-End: 328-720
actgtgtggccccgcaacccagcacaaccaggtatctgcttggaacccagccaccataaagcctgctagctaaaaaaaattttacatctctcagttcattcggcacagacccctgcctcattcagctgtgactctgcttggaaaattcatcagttacaaagcagccaatgcaattatctcaaggcattgaattctgcatcttttagtgaagaaaataactgaacatggttttcttctgaagacacaaagtccaaaggccaatcacacacctcttacatcgatctcttggaaattgaaaaatggacctttgaaaatgctagatttacaatgagaaatgccataattcaaggtttattctatgggtccttgacatttgggatctggacagctctgttattcatatatttgcaccataatcatgtgagcagctggcagaagaaaagccaggagcctctgtcagcttggtcccctggaaaaaaagtgcatcagcaaattatctatggctcagagcaaataccaaaacctcatgtaatagtcaaaaggactgatgaagataaagcaaagtctatgttaggtacagattttaaccatacaaacccagaacttcataaagaacttttaaaatatggatttaatgtgattatcagtagaagcttgggcatcgaaagagaagtgccagataccaggagtaaaatatgtactgtcaccttattaccataattatcagttgaaggagtaaagagtcaaaaagatgcaaataaggagaagtgtttgaacgagatgacacaacatccaaggcatttagatggatggttttcttcatattgcttctgcctgcaggtgtcttcaaaaacattacccagcccgcctcccgactgccagcattgtcatttgcttctataatgaagaatgtaatgccttgtttcagaccatgtccagtgtcacgaacctcacgccacactattttcttgaagaaattattttggtagatgacatgagcaaagttgctatgaggagctattaagggcttaatgcaggaaaatgagatgatctaggaattccatgaaagaagcggaatcagaccaactgcagttaaggcctggctcatggcgtcccacttttccctcctcttgctgcctcctacatcctggatgtgagtgaggtgtctggagatctttgagctgagatgctgcccaggcctgcaagtgcagctatgcagcctgtatccctgcctctttctaaaaacaaggaagaagatccctccttctgctgggattaccatgaacctgttcctgttcaacctgcccctgacccagattgctgggacttaggaatttagacctctgagatgatttgaaagaaaaactagactatcacctggaaacttttcggggaaaggttaaaataataagaaacaaaaagagagaggggctgattcgagcaaggctgattggagcttctcatgcttcaggggatgttctggtgttcctggacagccactgtgaggtgaacagagtatggctggagcccctgctgcatgccattgccaaggaccccaaaatggtggtgtgccccctgatagatgtcattgatgatagaactctggagtataagccctctcctcttgtaaggggaacttttgattggaacctacaatttaaatgggataatgttttctcttatgagatggatggaccagaaggatctactaaaccaatccggtcacctgcaatgtctggaggaatttttgctatacgtcggcattattttaatgaaattggacagtatgacaaggatatggatttttggggaagagaaaatttggaactttcactaaggatctggatgtgtggaggccaactctttataatcccctgctctcgagtaggacatatcagtaagaaacaaactggaaaaccttctacaatcatcagtgctatgacacataactacctaagactggtgcacgtttggctggatgaatataaggagcagttttttcttcgaaagcctggtctgaaatatgtcacctacggaaatattcgcgagcgtgttgagttaaggaaacgactgggttgcaagtcatttcagtggtatttggataatgtcttcccagagttggaggcatctgtgaacagcctgtgaaaggaaaacaaatcactttcattaataaagggttaaaagtctcctagtcattcaacatagtgtcacaagagtgtaagtttggaacatcgtggaattacgtgaaatgcaattaaaaaaatatgaccag

SEQ ID NO: 167723 - DNA, 1427 bp, Homo sapiens
  Payload ID: 12997
  Gene Symbol: GALNTL5
  Gene Name: polypeptide N-acetylgalactosaminyltransferase-like 5
  Uniprot ID: Q7Z4T8
  ENST ID: ENST00000448366
  CDS Start-End: 345-746
actgccctttgagtactactgtgtggccccgcaacccagcacaaccaggtatctgcttggaacccagccaccataaagcctgctagctaaaaaaaattttacatctctcagttcattcggcacagacccctgcctcattcagctgtgactctgcttggaaaattcatcagttacaaagcagccaatgcaattatctcaaggcattgaattctgcatcttttagtgaagaaaataactgaacatggttttcttctgaagacacaaagtccaaaggccaatcacacacctcttacatcgatctcttggaaattgaaaaatggacctttgaaaatgctagatttacaatgagaaatgccataattcaaggtttattctatgggtccttgacatttgggatctggacagctctgttattcatatatttgcaccataatcatgtgagcagctggcagaagaaaagccaggagcctctgtcagcttggtcccctggaaaaaaagtgcatcagcaaattatctatggctcagagcaaataccaaaacctcatgtaatagtcaaaaggactgatgaagataaagcaaagtctatgttaggtacagattttaaccatacaaacccagaacttcataaagaacttttaaaatatggatttaatgtgattatcagtagaagcttgggcatcgaaagagaagtgccagataccaggagtaaaatgggatgttctggtgttcctggacagccactgtgaggtgaacagagtatggctggagcccctgctgcatgccattgccaaggaccccaaaatggtggtgtgccccctgatagatgtcattgatgatagaactctggagtataagccctctcctcttgtaaggggaacttttgattggaacctacaatttaaatgggataatgttttctcttatgagatggatggaccagaaggatctactaaaccaatccggtcacctgcaatgtctggaggaatttttgctatacgtcggcattattttaatgaaattggacagtatgacaaggatatggatttttggggaagagaaaatttggaactttcactaaggatctggatgtgtggaggccaactctttataatcccctgctctcgagtaggacatatcagtaagaaacaaactggaaaaccttctacaatcatcagtgctatgacacataactacctaagactggtgcacgtttggctggatgaatataaggagcagttttttcttcgaaagcctggtctgaaatatgtcacctacggaaatattcgcgagcgtgttgagttaaggaaacgactgggttgcaagtcatttcagtggtatttggataatgtcttcccagagttggaggcatctgtgaacagcctgtgaaaggaaaacaaatcactttcattaataaagggttaaaagtc

SEQ ID NO: 167724 - DNA, 1808 bp, Homo sapiens
  Payload ID: 12997
  Gene Symbol: GALNTL5
  Gene Name: polypeptide N-acetylgalactosaminyltransferase-like 5
  ENST ID: ENST00000426341
  CDS Start-End: 332-724
tactactgtgtggccccgcaacccagcacaaccaggtatctgcttggaacccagccaccataaagcctgctagctaaaaaaaattttacatctctcagttcattcggcacagacccctgcctcattcagctgtgactctgcttggaaaattcatcagttacaaagcagccaatgcaattatctcaaggcattgaattctgcatcttttagtgaagaaaataactgaacatggttttcttctgaagacacaaagtccaaaggccaatcacacacctcttacatcgatctcttggaaattgaaaaatggacctttgaaaatgctagatttacaatgagaaatgccataattcaaggtttattctatgggtccttgacatttgggatctggacagctctgttattcatatatttgcaccataatcatgtgagcagctggcagaagaaaagccaggagcctctgtcagcttggtcccctggaaaaaaagtgcatcagcaaattatctatggctcagagcaaataccaaaacctcatgtaatagtcaaaaggactgatgaagataaagcaaagtctatgttaggtacagattttaaccatacaaacccagaacttcataaagaacttttaaaatatggatttaatgtgattatcagtagaagcttgggcatcgaaagagaagtgccagataccaggagtaaaatatgtactgtcaccttattaccataattatcagttgaaggagtaaagagtcaaaaagatgcaaataaggagaagtgtttgaacgagatgacacaacatccaaggcatttagatggatggttttcttcatattgcttctgcctgcaggtgtcttcaaaaacattacccagcccgcctcccgactgccagcattgtcatttgcttctataatgaagaatgtaatgccttgtttcagaccatgtccagtgtcacgaacctcacgccacactattttcttgaagaaattattttggtagatgacatgagcaaagttgatgatttgaaagaaaaactagactatcacctggaaacttttcggggaaaggttaaaataataagaaacaaaaagagagaggggctgattcgagcaaggctgattggagcttctcatgcttcaggggatgttctggtgttcctggacagccactgtgaggtgaacagagtatggctggagcccctgctgcatgccattgccaaggaccccaaaatggtggtgtgccccctgatagatgtcattgatgatagaactctggagtataagccctctcctcttgtaaggggaacttttgattggaacctacaatttaaatgggataatgttttctcttatgagatggatggaccagaaggatctactaaaccaatccggtcacctgcaatgtctggaggaatttttgctatacgtcggcattattttaatgaaattggacagtatgacaaggatatggatttttggggaagagaaaatttggaactttcactaaggatctggatgtgtggaggccaactctttataatcccctgctctcgagtaggacatatcagtaagaaacaaactggaaaaccttctacaatcatcagtgctatgacacataactacctaagactggtgcacgtttggctggatgaatataaggagcagttttttcttcgaaagcctggtctgaaatatgtcacctacggaaatattcgcgagcgtgttgagttaaggaaacgactgggttgcaagtcatttcagtggtatttggataatgtcttcccagagttggaggcatctgtgaacagcctgtga

SEQ ID NO: 167725 - DNA, 1344 bp, Homo sapiens
  Payload ID: 12997
  Gene Symbol: GALNTL5
  Gene Name: polypeptide N-acetylgalactosaminyltransferase-like 5
  Uniprot ID: Q7Z4T8
  ENST ID: ENST00000416062
  CDS Start-End: 248-649
ggactgtactgccctttgagtactactgtgtggccccgcaacccagcacaaccaggtatctgcttggaacccagccaccataaagcctgctagctaaaaaaaattttacatctctcagttcattcggcacagacccctgcctcattcagctgtgactctgcttggaaaattcatcagttacaaagcagccaatgcaattatctcaagggaaattgaaaaatggacctttgaaaatgctagatttacaatgagaaatgccataattcaaggtttattctatgggtccttgacatttgggatctggacagctctgttattcatatatttgcaccataatcatgtgagcagctggcagaagaaaagccaggagcctctgtcagcttggtcccctggaaaaaaagtgcatcagcaaattatctatggctcagagcaaataccaaaacctcatgtaatagtcaaaaggactgatgaagataaagcaaagtctatgttaggtacagattttaaccatacaaacccagaacttcataaagaacttttaaaatatggatttaatgtgattatcagtagaagcttgggcatcgaaagagaagtgccagataccaggagtaaaatgggatgttctggtgttcctggacagccactgtgaggtgaacagagtatggctggagcccctgctgcatgccattgccaaggaccccaaaatggtggtgtgccccctgatagatgtcattgatgatagaactctggagtataagccctctcctcttgtaaggggaacttttgattggaacctacaatttaaatgggataatgttttctcttatgagatggatggaccagaaggatctactaaaccaatccggtcacctgcaatgtctggaggaatttttgctatacgtcggcattattttaatgaaattggacagtatgacaaggatatggatttttggggaagagaaaatttggaactttcactaaggatctggatgtgtggaggccaactctttataatcccctgctctcgagtaggacatatcagtaagaaacaaactggaaaaccttctacaatcatcagtgctatgacacataactacctaagactggtgcacgtttggctggatgaatataaggagcagttttttcttcgaaagcctggtctgaaatatgtcacctacggaaatattcgcgagcgtgttgagttaaggaaacgactgggttgcaagtcatttcagtggtatttggataatgtcttcccagagttggaggcatctgtgaacagcctgtgaaaggaaaacaaatcactttcattaataaagggttaaaagtctcctagtcattcaa

SEQ ID NO: 167726 - DNA, 2097 bp, Homo sapiens
  Payload ID: 12997
  Gene Symbol: GALNTL5
  Gene Name: polypeptide N-acetylgalactosaminyltransferase-like 5
  ENST ID: ENST00000414073
  CDS Start-End: 305-697
acaaccaggtatctgcttggaacccagccaccataaagcctgctagctaaaaaaaattttacatctctcagttcattcggcacagacccctgcctcattcagctgtgactctgcttggaaaattcatcagttacaaagcagccaatgcaattatctcaaggcattgaattctgcatcttttagtgaagaaaataactgaacatggttttcttctgaagacacaaagtccaaaggccaatcacacacctcttacatcgatctcttggaaattgaaaaatggacctttgaaaatgctagatttacaatgagaaatgccataattcaaggtttattctatgggtccttgacatttgggatctggacagctctgttattcatatatttgcaccataatcatgtgagcagctggcagaagaaaagccaggagcctctgtcagcttggtcccctggaaaaaaagtgcatcagcaaattatctatggctcagagcaaataccaaaacctcatgtaatagtcaaaaggactgatgaagataaagcaaagtctatgttaggtacagattttaaccatacaaacccagaacttcataaagaacttttaaaatatggatttaatgtgattatcagtagaagcttgggcatcgaaagagaagtgccagataccaggagtaaaatatgtactgtcaccttattaccataattatcagttgaaggagtaaagagtcaaaaagatgcaaataaggagaagtgtttgaacgagatgacacaacatccaaggcatttagatggatggttttcttcatattgcttctgcctgcaggtgtcttcaaaaacattacccagcccgcctcccgactgccagcattgtcatttgcttctataatgaagaatgtaatgccttgtttcagaccatgtccagtgtcacgaacctcacgccacactattttcttgaagaaattattttggtagatgacatgagcaaagttgctatgaggagctattaagggcttaatgcaggaaaatgagatgatctaggaattccatgaaagaagcggaatcagaccaactgcagttaagaagaagatccctccttctgctgggattaccatgaacctgttcctgttcaacctgcccctgacccagattgctgggacttaggaatttagacctctgagatgatttgaaagaaaaactagactatcacctggaaacttttcggggaaaggttaaaataataagaaacaaaaagagagaggggctgattcgagcaaggctgattggagcttctcatgcttcaggggatgttctggtgttcctggacagccactgtgaggtgaacagagtatggctggagcccctgctgcatgccattgccaaggaccccaaaatggtggtgtgccccctgatagatgtcattgatgatagaactctggagtataagccctctcctcttgtaaggggaacttttgattggaacctacaatttaaatgggataatgttttctcttatgagatggatggaccagaaggatctactaaaccaatccggtcacctgcaatgtctggaggaatttttgctatacgtcggcattattttaatgaaattggacagtatgacaaggatatggatttttggggaagagaaaatttggaactttcactaaggatctggatgtgtggaggccaactctttataatcccctgctctcgagtaggacatatcagtaagaaacaaactggaaaaccttctacaatcatcagtgctatgacacataactacctaagactggtgcacgtttggctggatgaatataaggagcagttttttcttcgaaagcctggtctgaaatatgtcacctacggaaatattcgcgagcgtgttgagttaaggaaacgactgggttgcaagtcatttcagtggtatttggataatgtcttcccagagttggaggcatctgtgaacagcctgtgaaaggaaaacaaatcactttcattaataaagggttaaaagtctcctagtcattcaacatagtgtcacaagagtgtaagtttggaacatcgtggaattacgtgaaatgcaattaaaaaaatatgaccaga

SEQ ID NO: 167727 - DNA, 1763 bp, Homo sapiens
  Payload ID: 12997
  Gene Symbol: GALNTL5
  Gene Name: polypeptide N-acetylgalactosaminyltransferase-like 5
  Uniprot ID: Q7Z4T8
  ENST ID: ENST00000616416
  CDS Start-End: 307-1638
gcacaaccaggtatctgcttggaacccagccaccataaagcctgctagctaaaaaaaattttacatctctcagttcattcggcacagacccctgcctcattcagctgtgactctgcttggaaaattcatcagttacaaagcagccaatgcaattatctcaaggcattgaattctgcatcttttagtgaagaaaataactgaacatggttttcttctgaagacacaaagtccaaaggccaatcacacacctcttacatcgatctcttggaaattgaaaaatggacctttgaaaatgctagatttacaatgagaaatgccataattcaaggtttattctatgggtccttgacatttgggatctggacagctctgttattcatatatttgcaccataatcatgtgagcagctggcagaagaaaagccaggagcctctgtcagcttggtcccctggaaaaaaagtgcatcagcaaattatctatggctcagagcaaataccaaaacctcatgtaatagtcaaaaggactgatgaagataaagcaaagtctatgttaggtacagattttaaccatacaaacccagaacttcataaagaacttttaaaatatggatttaatgtgattatcagtagaagcttgggcatcgaaagagaagtgccagataccaggagtaaaatgtgtcttcaaaaacattacccagcccgcctcccgactgccagcattgtcatttgcttctataatgaagaatgtaatgccttgtttcagaccatgtccagtgtcacgaacctcacgccacactattttcttgaagaaattattttggtagatgacatgagcaaagttgatgatttgaaagaaaaactagactatcacctggaaacttttcggggaaaggttaaaataataagaaacaaaaagagagaggggctgattcgagcaaggctgattggagcttctcatgcttcaggggatgttctggtgttcctggacagccactgtgaggtgaacagagtatggctggagcccctgctgcatgccattgccaaggaccccaaaatggtggtgtgccccctgatagatgtcattgatgatagaactctggagtataagccctctcctcttgtaaggggaacttttgattggaacctacaatttaaatgggataatgttttctcttatgagatggatggaccagaaggatctactaaaccaatccggtcacctgcaatgtctggaggaatttttgctatacgtcggcattattttaatgaaattggacagtatgacaaggatatggatttttggggaagagaaaatttggaactttcactaaggatctggatgtgtggaggccaactctttataatcccctgctctcgagtaggacatatcagtaagaaacaaactggaaaaccttctacaatcatcagtgctatgacacataactacctaagactggtgcacgtttggctggatgaatataaggagcagttttttcttcgaaagcctggtctgaaatatgtcacctacggaaatattcgcgagcgtgttgagttaaggaaacgactgggttgcaagtcatttcagtggtatttggataatgtcttcccagagttggaggcatctgtgaacagcctgtgaaaggaaaacaaatcactttcattaataaagggttaaaagtctcctagtcattcaacatagtgtcacaagagtgtaagtttggaacatcgtggaattacgtgaaatgcaattaaaaaaatatgacc

SEQ ID NO: 167728 - DNA, 3922 bp, Homo sapiens
  Payload ID: 12998
  Gene Symbol: GALNTL6
  Gene Name: polypeptide N-acetylgalactosaminyltransferase-like 6
  Uniprot ID: Q49A17
  ENST ID: ENST00000506823
  CDS Start-End: 658-2463
gcagcgccctcgtccgcttccaagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagagcgctcacttctcagaggatcgcattccgaggaccgcgcgaggaagggacgtcgcggcgccaccacttcctggctggactccgctgacatctgtagcctcctttccaccaggttcccggggctcccagccgctgcctgcagaggagcgtgtagacagcgcgcgagggtccggcacttcgtggacctccatccgaaccggagttctgcccggatcccgagtccctggatcccggtggagcccgccggcaagctggctccggagggagttgaacttgagttcagatggccaactccctctgaatcctgcagattggtgctgagcacgcaacaaaagtttgtagcttctcagtttctggtgcttcgcaggggagaggaaaggaatttgacattaaacacaagaagcagtcagggagccatctcctttaacttttcttctctgttaccatttgcaatgaagaggaaacagaagagatttctgcagatgactttgttgttcacggtggctttaattttcctgcctaacgttggtctctggtctctgtacaaggataagcacctggtgaagtcagcggagcccggggagcagcagacatttccactgggcctgggagatgggcaattctattcatggacagatggtttgagaagaaaggactggcatgactatgaaagcattcagaaagaggctatgcgctcagggaaaggtgaacatgggaaaccttacccccttactgaagaggaccatgatgactcagcttacagggaaaatggttttaatattttcgtcagcaacaatattgctctagagaggtctctgccagatattcgtcatgctaactgtaagcataagatgtatctggaaaggctgccaaacaccagcatcattatcccatttcataatgaaggttggacttcactcctgcggaccatacacagtataattaaccgaaccccagggagtctgatagcagaaatcattctagtagatgacttcagtgagagagaacacctgaaggataaattggaagaatacatggcccgattttccaaagtgaggattgttcgcaccaagaaaagagaaggactcatccggacccgtctcctgggggcatctatggccagaggagaagtcctgacattcctggactcccactgcgaggtcaatgtgaactggctgcccccactcctcaaccaaattgcactaaaccacaaaaccatcgtgtgtcccatgatcgatgtcattgaccacaatcacttcgggtatgaggcacaagctggggatgccatgcgaggagccttcgactgggaaatgtactacaaaagaatccccatccctccagagctccagagggcagatcccagcgacccttttgagtctcctgttatggctggaggtctctttgctgtggatcggaaatggttttgggaattgggtggctatgatccaggtttagaaatctggggaggagaacagtatgaaatctcttttaaggtttggatgtgtggaggagaaatgtttgatgttccatgttctagagttggtcatatctacaggaagtacgttccatacaaagttccatctgggacaagcctggcaagaaacctgaagcgggtagctgagacctggatggatgaatttgccgagtacatttaccagcggcggccggagtacaggcatctctccacgggggacatctctgcccagaaggagctgcgcaagcagctcaagtgcaaggacttcaaatggttcatggctgctgtggcctgggacgtgcctaaatactaccctccagtggagcccccgcctgctgcctggggggagatccgaaatgtggcagcaaatctctgtgtggacagcaagcatggagccaccggaacagagctgaggctggacatctgtgtcaaggatggttctgaaagaacatggtctcatgaacagctttttacctttggatggagagaagatattcgacccggtgagccactgcatacccggaaattctgctttgatgcgatctcacacaacagccccgttacactctatgactgtcatggcatgaaggggaaccagctctggggataccggaaggacagaacattattccatcctgtgagcaacagctgcatggattgcaaccccgcagagaagaagattttcatggccagatgtgaccctctctctgagactcagcagtggatttttgaacacattaatatgactgttttagaaaaatttaaccaccatgccaactcctagaaagaagaaaggaagaaagagtgattacctacaggttataaattaaattttagccagcatctgggtcgaaggagtcaggaataacatttcctcgatccaggaaggctggtttaaaaatttgcaaatgccatgtcaaagtaggttgttttgaagaacttcctgcatctgaagaacttggctgagaatctcaccagctgcttctgagaactcgagactagcagttcccttgctggccaagggcaaagataatttagggacttttcaaaacaactgctgagctaataaatcctagcatttctcaggtcaaatcctgcagtagtgagtagctatgaatggatcctattaactgggtgggaggggggtgaaaatggagtgcatgactgctctgacaacctgaggatatcacaggtttagaactagccaagcttaaggggtgagctgtactctttggtgccattctctgactaagaatgggttcagcaggtttaacccttaaaagtgctgcagatgatttcagagtgctcacactattctgttttttttatttttatttttaaatgagggtgcaatatctaatgtaagacttaaattacataatgaaatggacatccagtgttcccattctttcgtttatatttgccatttttttttcagagcaaagtttcttttttatgaaagttcatgctccatgaatccactgaatttctaattcagtgcccttctatgaatccagttaaaaacaaaagcaaaagcaaaaatctatgctatcaagttactccaaagaaagatttcacagaagcagcaaaaccatataagatttaggagagggacttccctgggaaatctatttttacttttctattatttttaaaatcttaaaagtctgatatttgtccagtcataatttttattaagcaaggaaatggagtgagtttgatgtaatttgtttaggagattcttaaacccaaataaatctacactccaagtgatatgtgaaaatggcttagttcacttcaattctgtttagtcagtggtgggagcttagaagtggttttatttgttcgtttgtttgggttttgcttttgttttttatttttttcttgttttttttttgtagtgttgaattaatgatgttcttttatttggaagctcataaaaggaattaccattaataaagtgtttctgacaccattttctgttaatgggacaatatttcggggatgaagaaaggaatgctccgaaaactaaatggaacacttaatccttaaagcaattttttactgttcaataatatcacattgggggaagaaaacacaggtatcaaggtggttcttgggaaaaaagaatcatgtttattatatatctctcaagtttttttggtataaaaatgttttaactttgctttctttttggtttttgtttgaagttggttttcctgttaataaaaatttatataaca

SEQ ID NO: 167729 - DNA, 1755 bp, Homo sapiens
  Payload ID: 12998
  Gene Symbol: GALNTL6
  Gene Name: polypeptide N-acetylgalactosaminyltransferase-like 6
  Uniprot ID: Q49A17
  ENST ID: ENST00000508122
  CDS Start-End: 1-1755
atgagagccaagttcagagccggagctggccaccagaggaatccaagcattagtgcagaccacggagtgcatgagctggtttaccagacatttccactgggcctgggagatgggcaattctattcatggacagatggtttgagaagaaaggactggcatgactatgaaagcattcagaaagaggctatgcgctcagggaaaggtgaacatgggaaaccttacccccttactgaagaggaccatgatgactcagcttacagggaaaatggttttaatattttcgtcagcaacaatattgctctagagaggtctctgccagatattcgtcatgctaactgtaagcataagatgtatctggaaaggctgccaaacaccagcatcattatcccatttcataatgaaggttggacttcactcctgcggaccatacacagtataattaaccgaaccccagggagtctgatagcagaaatcattctagtagatgacttcagtgagagagaacacctgaaggataaattggaagaatacatggcccgattttccaaagtgaggattgttcgcaccaagaaaagagaaggactcatccggacccgtctcctgggggcatctatggccagaggagaagtcctgacattcctggactcccactgcgaggtcaatgtgaactggctgcccccactcctcaaccaaattgcactaaaccacaaaaccatcgtgtgtcccatgatcgatgtcattgaccacaatcacttcgggtatgaggcacaagctggggatgccatgcgaggagccttcgactgggaaatgtactacaaaagaatccccatccctccagagctccagagggcagatcccagcgacccttttgagtctcctgttatggctggaggtctctttgctgtggatcggaaatggttttgggaattgggtggctatgatccaggtttagaaatctggggaggagaacagtatgaaatctcttttaaggtttggatgtgtggaggagaaatgtttgatgttccatgttctagagttggtcatatctacaggaagtacgttccatacaaagttccatctgggacaagcctggcaagaaacctgaagcgggtagctgagacctggatggatgaatttgccgagtacatttaccagcggcggccggagtacaggcatctctccacgggggacatctctgcccagaaggagctgcgcaagcagctcaagtgcaaggacttcaaatggttcatggctgctgtggcctgggacgtgcctaaatactaccctccagtggagcccccgcctgctgcctggggggagatccgaaatgtggcagcaaatctctgtgtggacagcaagcatggagccaccggaacagagctgaggctggacatctgtgtcaaggatggttctgaaagaacatggtctcatgaacagctttttacctttggatggagagaagatattcgacccggtgagccactgcatacccggaaattctgctttgatgcgatctcacacaacagccccgttacactctatgactgtcatggcatgaaggggaaccagctctggggataccggaaggacagaacattattccatcctgtgagcaacagctgcatggattgcaaccccgcagagaagaagattttcatggccagatgtgaccctctctctgagactcagcagtggatttttgaacacattaatatgactgttttagaaaaatttaaccaccatgccaactcctag

SEQ ID NO: 167730 - DNA, 2905 bp, Homo sapiens
  Payload ID: 12998
  Gene Symbol: GALNTL6
  Gene Name: polypeptide N-acetylgalactosaminyltransferase-like 6
  ENST ID: ENST00000511251
  CDS Start-End: 1907-2092
tttctcaagtgagacactagagagagtagaaagggaggaagagatagggcgagaagaaaaggagggagggacagagatgaggacgagaaagaagaaaaaagggaaagagaaaataccgtctgaagtccacaggcttatctatcccaagcatgtctaccccacgcatgtgggcatcatatccaggttgtaacaaagaggtgaccatggcgtttatttttggctccagacaggcggattcagcctgcattgcatgcatgcatgtctgtcacctcatctaagtccccattccttccggagttgtgagctccagatccaagagtgcccagtgcacggtgctgggcacgctgtcccttggcgaggctgccacaggttcctgagtgtgcggtcaggggcgttggtgcattgatacgttaggcggagggaggagtaccatctgccagagtcttatctcgagtcccacgttttctggccatcgcggaggagtgtgcgaggacaggtagccctcgcagtgacaaggcgcgcggagtgcggtcgtgcaaggcgggggaggagcggggtggccctgccgaatcttaaccggggccccgggtgtttgcagacccaaataaagccgccttgggtctccacggtgtcctccagaagctgctgcctgagaactctgagcctcagctctgtcttgcttcgggatcctcttcctcctccttccccaccccctacctggcctgaacggcggaacgcgcggctcgggggatcccctctccctgggaccggccctgtcccgggtcgcctccacctcccgcagccgccgcgccccggctcgccgcgctcccgccggcaccatggaggaattcctgggacaaccgcctgcagccggcgacttttccccaggaatctctggcctggcgccctttgggtgagatgacggggtgctggcatccctgtcggtcccagattacccggaaaagccctggcaggtaaagagaggacccgcgcaggctgggagctcccactcctcctccagcgtcacgctcgccctccgccgctgcctcgcgtccgggtctgtttatatagcgtctggaggccgggaggcattgcccacccccgccaggcggcccgccctcccctcctgggctccgggctgccgcacgtggcagacaccagcgacgtctccgcggaaggcaggcgccggggagtggggcgcgggcgaccgtgtgcagccgcggcgcatctccgccttccgctcctcctcgcagcgccctcgtccgcttccaagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagagcgctcacttctcagaggatcgcattccgaggaccgcgcgaggaagggacgtcgcggcgccaccacttcctggctggactccgctgacatctgtagcctcctttccaccaggttcccggggctcccagccgctgcctgcagaggagcgtgtagacagcgcgcgagggtccggcacttcgtggacctccatccgaaccggagttctgcccggatcccgagtccctggatcccggtggagcccgccggcaagctggctccggagggagttgaacttgagttcagatggccaactccctctgaatcctgcagattggtgctgagcacgcaacaaaagtttgtagcttctcagtttctggtgcttcgcaggggagaggaaaggaatttgacattaaacacaagaagcagtcagggagccatctcctttaacttttcttctctgttaccatttgcaatgaagaggaaacagaagagatttctgcagatgactttgttgttcacggtggctttaattttcctgcctaacgttggtctctggtctctgtacaaggataagcacctggtgaagtcagcggagcccggggagcagcaggtaagtgccacccagagaaagatcacacaaggattggtaaggcagtgatcctcgcgcggggactcgagaaagccggtgtgggatcgccttgggttttcccccaagtcttgacagagctgattattacaagactctagagactttggggtttaagcaagtagatgttttaagattgcagccagtaacatcgtgacatgtacaactagtaaagaaggataagacaggtcaagaagaagagaagataatctttcaccattggtcttaggttgattttgacttgaggtggatgaaaggtaactgttcagctatggaggtgggagtgggtttggtgcaagtttaatgacaaggataggtttttgctttccatttggcatgcatgtctatgttcaggtgaattgggccaactaaatcattaagattgtgaagtggttctttaaaaatcaagctatggttttcagtattttggttgtaaattttgcttagcaacagctttttaccctgtcgaaacttaaagtctctctttcgtctcccctgttgctaaggtgctgccatggggcacacaggcagagttattaaggacgttcattccgtttcacagtcgcttgataacagtatgttgctaacagcttgctgtcatattggaaacacccatactaaagatatgtagtataatatgttttctttctacttaatatgtaactcattagtatgtatatacctcatgacttaacatggaccaaaataactgtgttccctggtgaacaataatgcaaaatagacttcccaaaatgttgatgaaaatcaatgttgtcgaattccttgtttgttaataaataaaatagcttccgtaattaaacgttt

SEQ ID NO: 167731 - DNA, 1254 bp, Homo sapiens
  Payload ID: 12998
  Gene Symbol: GALNTL6
  Gene Name: polypeptide N-acetylgalactosaminyltransferase-like 6
  ENST ID: ENST00000616459
  CDS Start-End: 1-1254
gaacacctgaaggataaattggaagaatacatggcccgattttccaaagtgaggattgttcgcaccaagaaaagagaaggactcatccggacccgtctcctgggggcatctatggccagaggagaagtcctgacattcctggactcccactgcgaggtcaatgtgaactggctgcccccactcctcaaccaaattgcactaaaccacaaaaccatcgtgtgtcccatgatcgatgtcattgaccacaatcacttcgggtatgaggcacaagctggggatgccatgcgaggagccttcgactgggaaatgtactacaaaagaatccccatccctccagagctccagagggcagatcccagcgacccttttgagtctcctgttatggctggaggtctctttgctgtggatcggaaatggttttgggaattgggtggctatgatccaggtttagaaatctggggaggagaacagtatgaaatctcttttaaggtttggatgtgtggaggagaaatgtttgatgttccatgttctagagttggtcatatctacaggaagtacgttccatacaaagttccatctgggacaagcctggcaagaaacctgaagcgggtagctgagacctggatggatgaatttgccgagtacatttaccagcggcggccggagtacaggcatctctccacgggggacatctctgcccagaaggagctgcgcaagcagctcaagtgcaaggacttcaaatggttcatggctgctgtggcctgggacgtgcctaaatactaccctccagtggagcccccgcctgctgcctggggggagatccgaaatgtggcagcaaatctctgtgtggacagcaagcatggagccaccggaacagagctgaggctggacatctgtgtcaaggatggttctgaaagaacatggtctcatgaacagctttttacctttggatggagagaagatattcgacccggtgagccactgcatacccggaaattctgctttgatgcgatctcacacaacagccccgttacactctatgactgtcatggcatgaaggggaaccagctctggggataccggaaggacagaacattattccatcctgtgagcaacagctgcatggattgcaaccccgcagagaagaagattttcatggccagatgtgaccctctctctgagactcagcagtggatttttgaacacattaatatgactgttttagaaaaatttaaccaccatgccaactcctag

SEQ ID NO: 167732 - DNA, 3155 bp, Homo sapiens
  Payload ID: 12999
  Gene Symbol: PTBP1
  Gene Name: polypyrimidine tract binding protein 1
  Uniprot ID: P26599
  ENST ID: ENST00000349038
  CDS Start-End: 74-1669
ctcggagccgttgggtcggttcctgctattccggcgcctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctc

SEQ ID NO: 167733 - DNA, 3069 bp, Homo sapiens
  Payload ID: 12999
  Gene Symbol: PTBP1
  Gene Name: polypyrimidine tract binding protein 1
  ENST ID: ENST00000350092
  CDS Start-End: 90-1673
tctacagcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcc

SEQ ID NO: 167734 - DNA, 3598 bp, Homo sapiens
  Payload ID: 12999
  Gene Symbol: PTBP1
  Gene Name: polypyrimidine tract binding protein 1
  Uniprot ID: P26599
  ENST ID: ENST00000356948
  CDS Start-End: 424-2097
gggcaaagcacgcttcccgccgcctgactcgccacgtacccactctcaagatggcgtctcccgcaaagccacgcgccagctgactggctcagacgccgtcacgtgatcccattttctccccctcccccgactacacaagccgtttccgccttcggccttgaggaataaccgcctcccccaataggcgcctgcgatttctctgggtcccgcccccgggcggccttctggccagtgggaggtgctggcgggggcccgcggggctctccccgccccctggctgcagcgggagccaatgggcagcgcgcgcgggggacgtgtgcgggcgtctccgccattttgtgagtctataactcggagccgttgggtcggttcctgctattccggcgcctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgcctt

SEQ ID NO: 167735 - DNA, 3185 bp, Homo sapiens
  Payload ID: 12999
  Gene Symbol: PTBP1
  Gene Name: polypyrimidine tract binding protein 1
  Uniprot ID: P26599
  ENST ID: ENST00000394601
  CDS Start-End: 47-1699
attccggcgcctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcgcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctc

SEQ ID NO: 167736 - DNA, 767 bp, Homo sapiens
  Payload ID: 12999
  Gene Symbol: PTBP1
  Gene Name: polypyrimidine tract binding protein 1
  ENST ID: ENST00000585956
  CDS Start-End: 1-767
cgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggac

SEQ ID NO: 167737 - DNA, 749 bp, Homo sapiens
  Payload ID: 12999
  Gene Symbol: PTBP1
  Gene Name: polypyrimidine tract binding protein 1
  ENST ID: ENST00000589575
  CDS Start-End: 37-749
ctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgct

SEQ ID NO: 167738 - DNA, 273 bp, Homo sapiens
  Payload ID: 12999
  Gene Symbol: PTBP1
  Gene Name: polypyrimidine tract binding protein 1
  ENST ID: ENST00000587094
  CDS Start-End: 105-273
gtttttcttgggttcagtcacttttaaaagtctgttaaacgtggtccgtgcagtctgtggtgtcagaagaggcgcagccctagagtgggtctggaccccttagcatgcgtgcgggcagcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcag

SEQ ID NO: 167739 - DNA, 314 bp, Homo sapiens
  Payload ID: 12999
  Gene Symbol: PTBP1
  Gene Name: polypyrimidine tract binding protein 1
  ENST ID: ENST00000585535
  CDS Start-End: 1-314
ttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccagggcctgaccaaggactacggcaactcacccctgcaccgcttcaagaagccgggctccaagaacttccagaacatattcccg

SEQ ID NO: 167740 - DNA, 578 bp, Homo sapiens
  Payload ID: 12999
  Gene Symbol: PTBP1
  Gene Name: polypyrimidine tract binding protein 1
  ENST ID: ENST00000586481
  CDS Start-End: 131-578
cggagccgttgggtcggttcctgctattccggcgcctccactccgtcccccgcgggtctgctctgtgtgccatggacggcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggc

SEQ ID NO: 167741 - DNA, 1030 bp, Homo sapiens
  Payload ID: 12999
  Gene Symbol: PTBP1
  Gene Name: polypyrimidine tract binding protein 1
  ENST ID: ENST00000585932
  CDS Start-End: 1-346
caacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagaggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagct

SEQ ID NO: 167742 - DNA, 1125 bp, Homo sapiens
  Payload ID: 12999
  Gene Symbol: PTBP1
  Gene Name: polypyrimidine tract binding protein 1
  ENST ID: ENST00000621737
  CDS Start-End: 1-683
agttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagaggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacga

SEQ ID NO: 167743 - DNA, 357 bp, Homo sapiens
  Payload ID: 12999
  Gene Symbol: PTBP1
  Gene Name: polypyrimidine tract binding protein 1
  ENST ID: ENST00000587191
  CDS Start-End: 113-357
tgtgtgccatggacggcattgtcccagatatagccgttggtacaaaggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatccc

SEQ ID NO: 167744 - DNA, 2201 bp, Homo sapiens
  Payload ID: 12999
  Gene Symbol: PTBP1
  Gene Name: polypyrimidine tract binding protein 1
  ENST ID: ENST00000627714
  CDS Start-End: 107-700
tgcgggcgtctccgccattttgtgagtctataactcggagccgttgggtcggttcctgctattccggcgcctccactccgtcccccgcgggtctgctctgtgtgccatggacggcattgtcccagatatagccgttggtacaaagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgcctt

SEQ ID NO: 167745 - DNA, 3691 bp, Homo sapiens
  Payload ID: 12999
  Gene Symbol: PTBP1
  Gene Name: polypyrimidine tract binding protein 1
  ENST ID: ENST00000635647
  CDS Start-End: 424-2190
gggcaaagcacgcttcccgccgcctgactcgccacgtacccactctcaagatggcgtctcccgcaaagccacgcgccagctgactggctcagacgccgtcacgtgatcccattttctccccctcccccgactacacaagccgtttccgccttcggccttgaggaataaccgcctcccccaataggcgcctgcgatttctctgggtcccgcccccgggcggccttctggccagtgggaggtgctggcgggggcccgcggggctctccccgccccctggctgcagcgggagccaatgggcagcgcgcgcgggggacgtgtgcgggcgtctccgccattttgtgagtctataactcggagccgttgggtcggttcctgctattccggcgcctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcggtgcgtggccccgcggcggaccccagcagcccggggacctcgggggtgggcccagccgcaggggccggggactcacggctgtgcctcccacagcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgcctt

SEQ ID NO: 167746 - DNA, 3057 bp, Homo sapiens
  Payload ID: 13000
  Gene Symbol: PTBP2
  Gene Name: polypyrimidine tract binding protein 2
  Uniprot ID: Q9UKA9
  ENST ID: ENST00000370197
  CDS Start-End: 56-1669
ggctcgctggctgcgtggctcggttcttgtgagcgaagctttgtccggttcggcaatggacggaatcgtcactgaggttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagggcttcctgttgcagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaaagagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgctttttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctgcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaaccttttcgtacacactcttgtgggacgtatcatataaatgtcagcactaagtaatgtcttgtttgtggctgaatatttttcgtagatgtttttgaagttgacatgacttacgtgcatttaaatatatattgccatccttagtttgtaattaagatttggaatatggttgtggatttctgagcatgtgcagactggtctagctagttcaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaacaaa

SEQ ID NO: 167747 - DNA, 3054 bp, Homo sapiens
  Payload ID: 13000
  Gene Symbol: PTBP2
  Gene Name: polypyrimidine tract binding protein 2
  Uniprot ID: Q9UKA9
  ENST ID: ENST00000370198
  CDS Start-End: 56-1666
ggctcgctggctgcgtggctcggttcttgtgagcgaagctttgtccggttcggcaatggacggaatcgtcactgaggttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagggcttcctgttgcagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgctttttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctgcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaaccttttcgtacacactcttgtgggacgtatcatataaatgtcagcactaagtaatgtcttgtttgtggctgaatatttttcgtagatgtttttgaagttgacatgacttacgtgcatttaaatatatattgccatccttagtttgtaattaagatttggaatatggttgtggatttctgagcatgtgcagactggtctagctagttcaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaacaaa

SEQ ID NO: 167748 - DNA, 3027 bp, Homo sapiens
  Payload ID: 13000
  Gene Symbol: PTBP2
  Gene Name: polypyrimidine tract binding protein 2
  Uniprot ID: Q9UKA9
  ENST ID: ENST00000426398
  CDS Start-End: 44-1639
gcgtggctcggttcttgtgagcgaagctttgtccggttcggcaatggacggaatcgtcactgaggttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgctttttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctgcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaaccttttcgtacacactcttgtgggacgtatcatataaatgtcagcactaagtaatgtcttgtttgtggctgaatatttttcgtagatgtttttgaagttgacatgacttacgtgcatttaaatatatattgccatccttagtttgtaattaagatttggaatatggttgtggatttctgagcatgtgcagactggtctagctagttcaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaacaaa

SEQ ID NO: 167749 - DNA, 12014 bp, Homo sapiens
  Payload ID: 13000
  Gene Symbol: PTBP2
  Gene Name: polypyrimidine tract binding protein 2
  Uniprot ID: Q9UKA9
  ENST ID: ENST00000609116
  CDS Start-End: 83-1681
cagccgccattttctcgccgcttgtgtggctcgctggctgcgtggctcggttcttgtgagcgaagctttgtccggttcggcaatggacggaatcgtcactgaggttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaaagagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgctttttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctgcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaaccttttcgtacacactcttgtgggacgtatcatataaatgtcagcactaagtaatgtcttgtttgtggctgaatatttttcgtagatgtttttgaagttgacatgacttacgtgcatttaaatatatattgccatccttagtttgtaattaagatttggaatatggttgtggatttctgagcatgtgcagactggtctagctagttcaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaacaaagttgggaggtttgatggttgtttaatttcattttgtgtgtactctgcttacccctgtagcatgctcaataaacacttctgtagctctatattcaccttttctgtctttctctgctgccttttctctctcctcttctttgttttcactccactgtgcttctgaattcatgtttattctctgccagggtgggaaaggagtaataatattacaattctatggctttataccataaataaatctagatgctgtgaaaatataccagctggttttttttaatttaaaagatggtaactgcttttcaggaggacacatattaaacatttcccaccctgttataatctactgctttaaagacataacttttattgtagcttgttaattctatctcttttgttcttgttgttttttttttttttccagtagatttatgcactaatagatcttttggatttgccatgctctcttgctgcagtttcatctttcatcttttgtgtctgctaaagatttcttactaatcttagactaccttgtgagttaacaaaaagaacttgatattactgggaagaaagagcagcatatctgcatatcagcatatctgcttttgccttgggtgggaagaatgatatacattcaagtatttaaaaacttagagtaatttgcatttaacaactgaggatgttactactgtaacttgttaagcagttacaattagggtgctatttatattcaaaatatttcggtcagtttttctaaacagatatattggtatcaaataactttggagttacacatgtttcttaggtttgttctgttataaaatatcccacacttatgcaaaacttacacataggataataaaaagtaaatgaaggaacataaaatatgttttactatacttaatgtagtaattcagttacctccaagaaagaagaatataataagtaaaataattttgtttacactagtgtcactgttgtcatctgaagaagaaccattagagtcaacagtctgggatgatttggaagctaggtgatctgtgtttttttcttaaaataacatcgtagcacagaggaactctaccagcatcagataagtctaaagtctaaaaaaccaataccagggttagtgaatagtaattgaacaaagcttctcaaggtgaagtttttctcagtaattagtggtggctataatatttgaaagtaggttctgtcaccttttcaggtgctcattgtgggtgggattgccttgggaaggagaaactaagtcctgagctgtgtgtgtggacttagtttgtgccagttgctaagctggtgggagttcccagtctccctagtgggagataaccagaaaccagctcttcctgcctaaggactacagcagattctatactgtcttacagtatgccctaatacggccttccttccaaagcaccaagtcactaaagggggattttgacattctagaatatttttaattcagtacatcaaattaacccaggccttggcatatagtgaattgcttattaaaagttaggtaaaaataaaaacagctttgtcgtatattagtactctatgactcttagagtgaacaagctaacaagtattcttaggacttagctgctttgttaatagaggtcttaacttgaatatttagaaataatcagaaaaattattttttggtattgaagatgtattttggaaatgggttttaaagtacctacttaaggaagagatatctacagtttatatttaacgttagcatttgaaagcaatgaagaaaatttttccttaaccaggaagtgtaatgaatcattatattagagattaaattaacactttggaagcattttagctcctagagttaaggttagtatagtgaaattatggtgattagcttaattcattcatgtacatctatttgtatcaccatataattactagggaaaggacaaatcacttttcaaagcctcaatgttatttgtaaaatggaggcaataagttctgctctgctcccctcacaggattattacagaggctcaaataggataagtgaaggaatgctatgcaattagttaactaatgccagttcccagactgccagatttgcccacagtaaacttcattatccacaatacatgttatcctaatatgtctttttgctacaaagaaatactaatgttttaaaattatttactagtttcataaagcagaaagatgtaaaatgcagttatagagagcatcccaagccagatgaaaagaaaccatggatttagctttatattttctgtttgaacttgatagcccaatcataaaatgcacatatttaattatagactgcacttaagatttcatatgtataaaaaagttgctgtgaaacaggtaattttaacactcaggaatttcaaggctaaggaagaaagacatactctcatgagcagctctgaacttcaaacaggattttctggctgccttaatatattaaaatggagcctaaatctgaaaacgtttttttcattcagaagaaagtacagaattcagtgaaattgagtatactaggaaatctgatggcaagaattcagcagaaagtcttaattttaaaccgtaatattcattgattatgcaaaaccttagttttatagttattctttgttattttgaatagcttccctttaaattttctagtttcagattttgcaaataaaagtgtacatgttaaagttatagagtattagattattcacattaagaactgttcaaatacgcggaaaaataaaaccgtaatgaacacctatgcacttcactcaactatatcactacctaacatattccatattttaaacgtaattatatattagttgaaagaaaacgttacagaatgaactgaaatcccatatgaacctctttctgatcttagttcaaaccttattctttcccaagaggtaattgttaccttcagtttagtattttattattcagtggttgcttttcaagaggaatttgtcctatattctgtaggctaaatttcttgttttgcctagttataaaaatggcaaataatatgatattgggtgtttaaatagtacaatattgttcaaaacacactttataatttttaacagactgtttggacattgataattcccctatcaaatctcatgacatttaaccaatttttaacaaggattttaaattgtgtttaagaaataagtcatttgggcctcaggtttctcttaaggatgtaaacaaggagctatatcattggtattttagacgctgaattatgtgtaaggtccttaaatacaaacataccctttgtagcttcacagagccacccgttttgcacttctctcgcttttcttcctccctctttggctcccatttcaatggacagaaagactatgtggcatctctattttcattcacttggtttattgtcttggtatgttgtataggtttttgaatcagaaaattttaacatttttagatatttcaaacatacaaaaaatagaagaatatttaacaaacccttgtcagcttcagttagcaacttagatcttcctcgtttcctccacccaattctcatctcctttattaatgcagatcccagatatattttatcaagaaattttgtagcatatatttgtgttgttttattcgtggtcatagttgctttctctaatatctagactagcctagctggtcaatactacttttcttcaaatcctagaacctccctattaaaaatatagtcaccagaccagtggcaaattagtatcacctaggagtttattagaaactcagtctatgagcctactgaatctacattttgacaagattggcaggtgatgcatttggacataagttggagaagcactcaatgcattttttcagttctataaaaatcagcttcaaagttttttcctgagtgtggaaattatttcattagtaattttaagttatgcagatatagttaataccaagaaataattgaactgaaaaggaacccggatatctagttttaaccagctgttttaaagataaacagttctagagatcaaatgaatagtttagcaacatatttattgtaacttacctgtagttagaatccaagtccctggctttccaatccagtcttcaatgtataatactgatcaaaagaaatacaggcctgctattattcataaatttaaactattatgtacaagttgatagcttataatagaaatcagtatgattagtgttaaaagtcaaatttagtctgacagggaaggaatgtccatgtgaactgattttttttaatagaatgcaaattaatactcaattcctgatttgtttattacattttgtggtttaatgaaatgatactcaggtcattttcataaatagcttttctattaatgcttcctcagtcacattctctattcctattgcatagcacagtctaacagttgaaatgcctaagccttactgaatgatgactgatattctctgtgagagttagagctgtactataaatatacattacctgtgcaaagtatgccttcaggggctattccccataaccttagcaaaattttaaaatattcttatggctagcaatcttatctattgtcatgtcttactatttcctgcttaccacccccatttctctctcaaccttgttgctgcattagctgtccatcacttaacactgtttatttctctgtttttcttccatcattctcttctttgcaactaaatgatttagactttttataaccataatcaaccagttagattctttttatttgtggttattgagttgataaatgatagtgcattttatgtaatattcaggtgttatgctatttttatctggttcactttaaaacctccctccccccactccctttttttgtgggttttttttttattattattattttccagttttgtgttgttttgctttttaacttctgagattgcagtggttccagatggttgaaatcactagtagtgatttacatgaagcattcatgtatttattactggtatattcaactatggtggagggaaattggtcgaagaattacggttaaagagctcctttaaaaaggagatttgtagaattctaaaatgtgattctgattcatatagtcatgattcttagaaattagctacaggaagagatagaaacattgctatagttgtctttgccctaagtttggagttttatagtgtaatatatatataatagctctaattataaatacacttttactctggaaaaagcatagacattgacataagagacatttaaaaaccattattttctcatctgtaaaatggagagaattacttcatatgttcacttataaggattatgtgaaatactgttccattccattagtagtttttcttttcctctaattgggggtgggggcagtttttggcattctatttatggaaggtgtttttttccctaagatcattttgatgtctcagaagacatttgctatgtacgttggacatttgccatgtacattgtagagaatacaaagataaacagaaccacagtacagctggttctattagacattgaaaatgcatattctagcatatttaatatattagggaacaatttaagcataatgtgaatttcatgtttactgaagatttcatcctgagaaacaaatgaaagcagaaaattacaaccaactgaaccagctgtgtaagaaatatatatatggtgtgcacacatgtacatacctcagacatctattagcattctcagttttccacaagttaaaagccacgctcatccatatctggtgctaataacttcctatccaatttcagatagctgttttcaacacatctgacaccttctttttttcaagcaaacttcaggtctttttcaagataaagtcatttatagtagtgtctatatatttcttaaccatttaacatgtaaactgtgctgccttttaagaaattaattctatcctttttagtgtcagagttgaagattttgagtgttgtgccctaaccttatcattttcctcataagtcctgtggtttttattgtatgattttgcatagtgtggcaattcttggaaatgcttatgttgtgttatagtataactgacttactactttcaaatagcttctagtctgattcatgttatgacagtatacagtatagcaaaataaggacatcagggaacaggaggctgagcatatcaccatttaccaatggtagcttgagcaaggcacttcatttatcgaagtccattttctcatctgtacaatggaggtgatgatagtacatgtcttttctgtcttgtgttatttgtagtttcaagtaagatatgaaatatgctgtagaaatacagggttgggaatatctagtggtacaaaaatcaacttttggcccaattttaaggtgagataattatgagacatttttcgacctcaaagtctttgttcttttctctctacaccattgtgaataacacagtgtatatatgagattaatttattacctcgactttccatttttgttttgtaaagtagtttaattttttatatctatttataaagttaactgcaggagtgtacctgcagttaactttatacagttaagaagaggttggtttcagttttaaagattgtatgtcagtgtaaaacatccattattatgctttcaagtaaaatagctcctaaaaatatggattactatcaactttcaaggaaaatagctcctaaaaatatggattactaccaactttcaaggaaaatagctcctagaaatatggattactagccacataaattgctaacatttgcttttattattattattattattattttagacacagtcttgctctgtcacccaggctggagtgcggtggtattatctcggctcactgcaacctccacctctcgggttcaagcaattctcctgcctcagccttccgagtagctggaattacaggcacccaccaccacacccagctaatttttgtatttttagtagagacagggttttaccatgtgaccaggctggtttcgaactcctgacctcaaatgatccacctgcctcagcctcccaaactgctgggattacaggtgtgagccaccgctcccagcctatttgctaatatttaacctcttgagagtctttaattctttttttcaacaagtgttcattacctgctatgtgccagcttagatgctttggatgaaatacaggttggtgcgaaagtaattgcgatttttgccgttaaaattagaaaaaccacaattacttttgcaccaacctaaataactaaaacacaatttcttcctatcatggggctttcagttcagtatgagataagtaaagaattatatgggttgataaattttctggaggaactattgggtgttattacagtgtgctcaatctttagcagttaggaaaggattcttgaaggtagttgtattacctgggttggaggtaagtgttggggacacaagtgttagaaacagaacagtttgtttaaaagttggggacaaaaaaggaccagaatcaagattacggcaccctggagaaagttaagcatggctcggtcataaattaggagacaaggaacaaatagagaaatacgtttggatagaatagtcagattataggctgtgctaagttgtttgggctccactagggtttctaaatgcagttattggtaaactggacttaggagaagggacagggttgacatgacaaatctagtgaatttatgttcattaaaatatcccttttgaattgatttagtttttgtatgtttcttttttataattccaaaaaatcatacaaataagttaaacttatccatctaaaagctgcacacaaaacttgatgttagattcttttaaaattacaaaattaagacttccaaaagaatcttgttgaataagagtaaaagaaagacccttactcagtaaagctgcgtaatactttggcagtttgaacccatggccatgcctctctgtgtgataaggatttggcaaaaccatggaagaaacatgcatgtttttgaattgtctttccatggtaacttaaaacattttttcatgaaacatggatatatatccttagaaaactgcaaaacataaagcttgtaagttataagacaagatttatctcttttttttttttttctgagagagagtcttgctctgttgcccaggccggagtgcaacagtgtgatctctgctcactgcaccctccgcctcccgggttcaagcaattctcctgcctcagcctcctgagtagctgggactacaggcgtgtgccgccaagcccagctaatttttttgtatctttagtagagacggtttcaccatgttggccaggctggtctcgaactcctgacctcaagtgatctacctgcctcagccttctaaagtgttgggattacaggcatgagccatggcacccggccaagatgaaatgtcaaggccattttagccactatgcttttaagactacttaaagctgtgctttcaggtctccccaggaatacttgttcactctatactattgctgctgctgttctggcttgagaattttgagaatcactaagatacaattttaagttttgacatgtaaattatttggttgagtagaaagaattaatgtagataagcaaaaacccctttataaaaaatgcttaccctttaaaaaatgttgaatcctcacagtatgattaaatactacttgtaaaagtgtctgttaaccataatgtattttttagataatttgagtagaattatacgtgcaatatattcttgagtttgtgaccaacaaagaaacagattaatgattgaaaattcaccatacattactacctatgtctctccacctgctatctacttccaattttttatatatataaaagtcattaaagtcatttgtaattg

SEQ ID NO: 167750 - DNA, 734 bp, Homo sapiens
  Payload ID: 13001
  Gene Symbol: PTBP3
  Gene Name: polypyrimidine tract binding protein 3
  ENST ID: ENST00000210227
  CDS Start-End: 187-734
ggcgaggtggggcgagcggccgacggcgggtgcacgcgtcggtacacgtctgggcggcgacctggtcgcaagccatggtcccacgcggggtcccagggccgccgcgggacttggccgaggtctcccgacttgtgctgtgagatacgttaacgctttctcgacaccaggggtctggacttagtgaccatggacgcttccccctcacctttctctctccccaagaaacttaatgaattatctgcccgtcggggatctgatgagcttctttcttctggcatcattaacggaccttttaccatgaatagttctactccttctacagctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgg

SEQ ID NO: 167751 - DNA, 7990 bp, Homo sapiens
  Payload ID: 13001
  Gene Symbol: PTBP3
  Gene Name: polypyrimidine tract binding protein 3
  Uniprot ID: O95758
  ENST ID: ENST00000334318
  CDS Start-End: 188-1855
ggcgcggcggtggcgggagcgtgcccggtccccgcccctgttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggtgttgttacagatcttataacagtcggtttaaagcggggatctgatgagcttctttcttctggcatcattaacggaccttttaccatgaatagttctactccttctacaggtgtgtatgctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttatgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagaaccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaatgcgtagtgcatggttaattcaagcttctgtacactacagtatattccattttcgttcagtttgtatatttgctgactattacttgatatctctaatctcttttcctaacaaatatagcattgtagcatgccttttaataaatgtcatgacatctgtactctcttaaaatttttctgtgttcttgtctgtactttgggtttccctttgtcttacctgtaattctaatgatgtcctattttcttttcttttccatagccatccatctaaacgtgtcatggttagtgaatagtgagcacatattcaaacaatgttcaaaatgggaaaaacacaaaatctattaactgtctctgtcttcatttaggaataattctcgttttgaggagcaaagtgctttcctaatcttcctatgatgcaccttctctggcactgccccgtaatgcaggggcatggcggcatgctttcttgcttgcacactcactctcctttttctttctctctttctccccatatgtgcagtgccaaactacagttggaacactatttccagttttgttcagtatttggcttccctacggcattagtatacatacactttgagacacaaggtgtgatctcaaaccaaatttgtgtcctctttaaaaaggtagcacagatactagctgatgctacattccttttccttagacaaacgttttacttctcagatctttaaagaattgttggattgcagaagtctagacttagcgttcattgtatattttagtctcctggaagtgggaatttattttgaatggaatagaaaattaggtaatcactactaatctttgctggcttacctgtaaaatctgtggtctccataaatactgggaaaataaataggtattttt

SEQ ID NO: 167752 - DNA, 2755 bp, Homo sapiens
  Payload ID: 13001
  Gene Symbol: PTBP3
  Gene Name: polypyrimidine tract binding protein 3
  Uniprot ID: O95758
  ENST ID: ENST00000343327
  CDS Start-End: 192-1565
aaagctcgcttgtccccggaaccgccctgctgccgccgcctgcttcctctgctcgcggttagcccgtcagtccctgctctgtgcgcgcctccatctgggccatggatggcggggatctgatgagcttctttcttctggcatcattaacggaccttttaccatgaatagttctactccttctacaggtgtgtatggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaatttt

SEQ ID NO: 167753 - DNA, 3413 bp, Homo sapiens
  Payload ID: 13001
  Gene Symbol: PTBP3
  Gene Name: polypyrimidine tract binding protein 3
  Uniprot ID: O95758
  ENST ID: ENST00000374255
  CDS Start-End: 149-1807
gttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggtgttgttacagatcttataacagtcggtttaaagcggggatctgatgagcttctttcttctggcatcattaacggaccttttaccatgaatagttctactccttctacagctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaa

SEQ ID NO: 167754 - DNA, 7240 bp, Homo sapiens
  Payload ID: 13001
  Gene Symbol: PTBP3
  Gene Name: polypyrimidine tract binding protein 3
  Uniprot ID: O95758
  ENST ID: ENST00000374257
  CDS Start-End: 250-1824
gggggcgcggcggtggcgggagcgtgcccggtccccgcccctgttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggcggggatctgatgagcttctttcttctggcatcattaacggaccttttaccatgaatagttctactccttctacaggtgtgtatgctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttatgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagaaccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaatgcgtagtgcatggttaattcaagcttctgtacactacagtatattccattttcgttcagtttgtatatttgctgactattacttgatatctctaatctcttttcctaacaaatatagcattgtagcatgccttttaataaatgtcatgacatctgtactctcttaaaa

SEQ ID NO: 167755 - DNA, 368 bp, Homo sapiens
  Payload ID: 13001
  Gene Symbol: PTBP3
  Gene Name: polypyrimidine tract binding protein 3
  ENST ID: ENST00000450374
  CDS Start-End: 138-368
ccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggtgttgttacagatcttataacagtcggtttaaagcggggatctgatgagcttctttcttctggcatcattaacggaccttttaccatgaatagttctactccttctacaggtgtgtatgctaatgggaatgacagcaagaaatttaaacgagatagacctccctgttcgccttcccgtgttctccatcttcgaaaaattccatgtgatgtcaccgaagcagag

SEQ ID NO: 167756 - DNA, 7995 bp, Homo sapiens
  Payload ID: 13001
  Gene Symbol: PTBP3
  Gene Name: polypyrimidine tract binding protein 3
  Uniprot ID: O95758
  ENST ID: ENST00000458258
  CDS Start-End: 184-1860
gaggtggggcgagcggccgacggcgggtgcacgcgtcggtacacgtctgggcggcgacctggtcgcaagccatggtcccacgcggggtcccagggccgccgcgggacttggccgaggtctcccgacttgtgctgtgagatacgttaacgctttctcgacaccaggggtctggacttagtgaccatggacgcttccccctcacctttctctctccccaagaaacttaatgaattatctgcccgtcggggatctgatgagcttctttcttctggcatcattaacggaccttttaccatgaatagttctactccttctacagctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttatgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagaaccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaatgcgtagtgcatggttaattcaagcttctgtacactacagtatattccattttcgttcagtttgtatatttgctgactattacttgatatctctaatctcttttcctaacaaatatagcattgtagcatgccttttaataaatgtcatgacatctgtactctcttaaaatttttctgtgttcttgtctgtactttgggtttccctttgtcttacctgtaattctaatgatgtcctattttcttttcttttccatagccatccatctaaacgtgtcatggttagtgaatagtgagcacatattcaaacaatgttcaaaatgggaaaaacacaaaatctattaactgtctctgtcttcatttaggaataattctcgttttgaggagcaaagtgctttcctaatcttcctatgatgcaccttctctggcactgccccgtaatgcaggggcatggcggcatgctttcttgcttgcacactcactctcctttttctttctctctttctccccatatgtgcagtgccaaactacagttggaacactatttccagttttgttcagtatttggcttccctacggcattagtatacatacactttgagacacaaggtgtgatctcaaaccaaatttgtgtcctctttaaaaaggtagcacagatactagctgatgctacattccttttccttagacaaacgttttacttctcagatctttaaagaattgttggattgcagaagtctagacttagcgttcattgtatattttagtctcctggaagtgggaatttattttgaatggaatagaaaattaggtaatcactactaatctttgctggcttacctgtaaaatctgtggtctccataaatactgggaaaataaataggtattttt

SEQ ID NO: 167757 - DNA, 3596 bp, Homo sapiens
  Payload ID: 13002
  Gene Symbol: PNPT1
  Gene Name: polyribonucleotide nucleotidyltransferase 1
  ENST ID: ENST00000260604
  CDS Start-End: 20-559
tgaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcggtaagtataaaagtagagattaaaattatcagattaaaaatttttttaaagcaatgaaattttaatttcggccctgatttttctccttttttaagcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgatttttttttttaaagagaattctagaattctattttgtctagggtgatgtgctgtagagcaacattttagtagtatcttccattgtgtagatttctatataatataaatacattttaattatttgtactaaaatgctcatttacatgtgccatttttttaattcgagtaacccatatttgtttaattgtatttacattataaatcaagaaatatttattattaaaagtaagtcatttatacatcttagaaaaaattacatagttttgtttttacaattctgaaatatatgaaaaacttagatagaatatgtcatatgttattataacagatctcttcctacatcttatttttcttctttgtatacagtagtgacagtttaccttcagtcatcctacaggtcacctctgtgcccaacaactttacttgcctacaacggttcacaaactggaacaggccatattcaaagccagtgcctatttcttcagaactgttaacagatatagtgagttgagggagctaatctgatacacttttgataatataatgcctttcaaattagttaccaaatcataaacagagtggaataaatataaatgagattctaactaggatgaatgtggtagtaatgatgtatatttttcaaatttacctaaacagaaagattattggctaaggcaggcggatcatgagatcaggagatcgagaccatcctggctaacacggtgaaaccccgtctctactaaaagtgcaaaaattagccgggcgtggtggcgcatgcctgtaatcctagctactcaggaggctgaggcagaagaatcacttcaacccaggaggtggaggttgtagtgagccgagattgcgccattgcactccagctcaggcaacaagagcaaaactccgtctcaaaaaaaaaaaaaaaattgtttacttatcaaattgaactaggtcaatttgaatatgtgtattgctctaatgtatggaagttcttagtataagagctgaaggatcatgactttcggttaatagatgtttgaaatagatgtttagaggttactgatacacatgtcaagttgttcattcccatcatttaaaatatcaccttataattccacagaaaagtaaatggtatgtggacgtcataa

SEQ ID NO: 167758 - DNA, 3308 bp, Homo sapiens
  Payload ID: 13002
  Gene Symbol: PNPT1
  Gene Name: polyribonucleotide nucleotidyltransferase 1
  Uniprot ID: Q8TCS8
  ENST ID: ENST00000415374
  CDS Start-End: 1-2352
atggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgatttttttttttaaagagaattctagaattctattttgtctagggtgatgtgctgtagagcaacattttagtagtatcttccattgtgtagatttctatataatataaatacattttaattatttgtactaaaatgctcatttacatgtgccatttttttaattcgagtaacccatatttgtttaattgtatttacattataaatcaagaaatatttattattaaaagtaagtcatttatacatcttagaaaaaattacatagttttgtttttacaattctgaaatatatgaaaaacttagatagaatatgtcatatgttattataacagatctcttcctacatcttatttttcttctttgtatacagtagtgacagtttaccttcagtcatcctacaggtcacctctgtgcccaacaactttacttgcctacaacggttcacaaactggaacaggccatattcaaagccagtgcctatttcttcagaactgttaacagatatagtgagttgagggagctaatctgatacacttttgataatataatgcctttcaaattagttaccaaatcataaacagagtggaataaatataaatgagattctaactaggatgaatgtggtagtaatgatgtatatttttcaaatttacctaaacagaaagattattggctaaggcatggtggctcacacctgtaatcccaacactttgggaggtcaaggcgggtagatcacctgaggtcaggagttcgagaccagcctggccaacatggtgaaaccccatctctactaaaaatacaaaaattagctgggtgtggtggcgggcgcctgtaatcccagctactcaggaggctgaggcaggagaatctcttgaacctgggaggcagaggtggcagtgagctgagatcgcaccactgcactccagcctgggcaaaaagagtaaaactccatctcaaaa

SEQ ID NO: 167759 - DNA, 4411 bp, Homo sapiens
  Payload ID: 13002
  Gene Symbol: PNPT1
  Gene Name: polyribonucleotide nucleotidyltransferase 1
  Uniprot ID: Q8TCS8
  ENST ID: ENST00000447944
  CDS Start-End: 88-2439
ggaaacgaaactccatcaggctccgccccacggtctgcggagtgagccaatcagggcacagcctgcgttgaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgatttttttttttaaagagaattctagaattctattttgtctagggtgatgtgctgtagagcaacattttagtagtatcttccattgtgtagatttctatataatataaatacattttaattatttgtactaaaatgctcatttacatgtgccatttttttaattcgagtaacccatatttgtttaattgtatttacattataaatcaagaaatatttattattaaaagtaagtcatttatacatcttagaaaaaattacatagttttgtttttacaattctgaaatatatgaaaaacttagatagaatatgtcatatgttattataacagatctcttcctacatcttatttttcttctttgtatacagtagtgacagtttaccttcagtcatcctacaggtcacctctgtgcccaacaactttacttgcctacaacggttcacaaactggaacaggccatattcaaagccagtgcctatttcttcagaactgttaacagatatagtgagttgagggagctaatctgatacacttttgataatataatgcctttcaaattagttaccaaatcataaacagagtggaataaatataaatgagattctaactaggatgaatgtggtagtaatgatgtatatttttcaaatttacctaaacagaaagattattggctaaggcaggcggatcatgagatcaggagatcgagaccatcctggctaacacggtgaaaccccgtctctactaaaagtgcaaaaattagccgggcgtggtggcgcatgcctgtaatcctagctactcaggaggctgaggcagaagaatcacttcaacccaggaggtggaggttgtagtgagccgagattgcgccattgcactccagctcaggcaacaagagcaaaactccgtctcaaaaaaaaaaaaaaaattgtttacttatcaaattgaactaggtcaatttgaatatgtgtattgctctaatgtatggaagttcttagtataagagctgaaggatcatgactttcggttaatagatgtttgaaatagatgtttagaggttactgatacacatgtcaagttgttcattcccatcatttaaaatatcaccttataattccacagaaaagtaaatggtatgtggacgtcataatttagaatgtgtaatcttttttaaaatcttataaaaatacactggactcagtggtacgtgcctgtagtcccagctacttggaaggctgaagtgggaaggtcactagagcccagaagttcgacactgtagtgtgcaacaatcatacctgtgaatagctactgtactccagcctgggcaacatagcaggactcttatctctaaaaaaaattttaaatcttataaaaatgtaggtatatctggccaggcatggtggctcacacctgtaatcccaacactttgggaggtcaaggcgggtagatcacctgaggtcaggagttcgagaccagcctggccaacatggtgaaaccccatctctactaaaaatacaaaaattagctgggtgtggtggcgggcgcctgtaatcccagctactcaggaggctgaggcaggagaatctcttgaacctgggaggcagaggtggcagtgagctgagatcgcaccactgcactccagcctgggcaaaaagagtaaaactccatctcaaaaaaaaaaatggtgggcacagaagctcatgcctgtaattccagcactttgggaggccgaggcgggtggattacatgaggtcaggaattcaagaccagcctggccaacacggtaaaaccccatctctactaaaaatacaaaaattagctgggcatggtggcaggcacctgtaatcctagctactcgggaggctgaggcaggagaatcacttgagcctgggaaatggaggttgcagtgagccgagattgcgccattgcactccagcctgggcgacagagcaagactccgtctccagaaaaaaaaaaaa

SEQ ID NO: 167760 - DNA, 555 bp, Homo sapiens
  Payload ID: 13002
  Gene Symbol: PNPT1
  Gene Name: polyribonucleotide nucleotidyltransferase 1
  ENST ID: ENST00000415489
  CDS Start-End: 1-418
agatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgaggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaa

SEQ ID NO: 167761 - DNA, 583 bp, Homo sapiens
  Payload ID: 13002
  Gene Symbol: PNPT1
  Gene Name: polyribonucleotide nucleotidyltransferase 1
  ENST ID: ENST00000429805
  CDS Start-End: 41-256
caatcagggcacagcctgcgttgaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattg

SEQ ID NO: 167762 - DNA, 216 bp, Homo sapiens
  Payload ID: 13002
  Gene Symbol: PNPT1
  Gene Name: polyribonucleotide nucleotidyltransferase 1
  ENST ID: ENST00000625249
  CDS Start-End: 1-216
atggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggttgactacagacaaaaagctgctgcagcaggtagaattcccacaaactatctga

SEQ ID NO: 167763 - DNA, 977 bp, Homo sapiens
  Payload ID: 13003
  Gene Symbol: PBDC1
  Gene Name: polysaccharide biosynthesis domain containing 1
  ENST ID: ENST00000373357
  CDS Start-End: 100-798
agggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattgagatggcttgggccatgagagcaatgcagcatgctgaagtctattacaagctgatttcatcagttgacccacagttcctgaaactcaccaaagtagatgaccaaatttactctgagttccggaaaaattttgagacccttaggatagatgtgttggacccagaagaactcaagtcagaatcagccaaagagcccccaggatacaattctttgccattgaaattgctcggaaccgggaaggctataacaaagctgtttatatcagtgttcaggacaaagaaggagagaaaggagtcaacaatggaggagaaaaaagagctgacagtggagaagaagagaacaccaagaatggaggagagaaaggagctgatagtggagaagaaaaagaggaaggaatcaacagagaagacaaaactgacaaaggaggagaaaaagggaaagaagctgacaaagaaatcaacaaaagtggtgaaaaagctatgtaaggtatacagggaacagcactctagaagctatgactcaattgagactacaagtaccacggtgctacttgcacagacccctttggttaaatgtaaattcttgtacaattgaaggatacgcagaaggacatctttctagtctaacagtcaggagctgctctggtcattcccttgtatgaactggtctaaagactgttagtggggtgttagttgatttttcctggtatactgtttcttggctgacactactggtcaagtaagaaatttgtaaataaatttcttttggttctt

SEQ ID NO: 167764 - DNA, 1201 bp, Homo sapiens
  Payload ID: 13003
  Gene Symbol: PBDC1
  Gene Name: polysaccharide biosynthesis domain containing 1
  Uniprot ID: Q9BVG4
  ENST ID: ENST00000373358
  CDS Start-End: 204-905
gtcaatcacctcagatctctcaagcagtccagcctacgcaacagtactccacctctgcgcctgtgcggggagggtaaggcggggccagcaacttcctcagctggagggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattgagatggcttgggccatgagagcaatgcagcatgctgaagtctattacaagctgatttcatcagttgacccacagttcctgaaactcaccaaagtagatgaccaaatttactctgagttccggaaaaattttgagacccttaggatagatgtgttggacccagaagaactcaagtcagaatcagccaaagagaagtggaggccattctgcttgaagtttaatgggattgttgaagacttcaactatggtactttgctgcgactagattgttctcagggctacactgaggaaaacaccatctttgcccccaggatacaattctttgccattgaaattgctcggaaccgggaaggctataacaaagctgtttatatcagtgttcaggacaaagaaggagagaaaggagtcaacaatggaggagaaaaaagagctgacagtggagaagaagagaacaccaagaatggaggagagaaaggagctgatagtggagaagaaaaagaggaaggaatcaacagagaagacaaaactgacaaaggaggagaaaaagggaaagaagctgacaaagaaatcaacaaaagtggtgaaaaagctatgtaaggtatacagggaacagcactctagaagctatgactcaattgagactacaagtaccacggtgctacttgcacagacccctttggttaaatgtaaattcttgtacaattgaaggatacgcagaaggacatctttctagtctaacagtcaggagctgctctggtcattcccttgtatgaactggtctaaagactgttagtggggtgttagttgatttttcctggtatactgtttcttggctgacactactggtcaagtaagaaatttgtaaataaatttcttttggttcttattatcta

SEQ ID NO: 167765 - DNA, 1804 bp, Homo sapiens
  Payload ID: 13004
  Gene Symbol: PUF60
  Gene Name: poly-U binding splicing factor 60KDa
  Uniprot ID: Q9UHX1
  ENST ID: ENST00000313352
  CDS Start-End: 162-1661
gcgcggcgtgtggcccttgcgggcgagcctggcggggttgcgttcctgtccgctagcaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaa

SEQ ID NO: 167766 - DNA, 1821 bp, Homo sapiens
  Payload ID: 13004
  Gene Symbol: PUF60
  Gene Name: poly-U binding splicing factor 60KDa
  Uniprot ID: Q9UHX1
  ENST ID: ENST00000349157
  CDS Start-End: 50-1678
ggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaa

SEQ ID NO: 167767 - DNA, 1736 bp, Homo sapiens
  Payload ID: 13004
  Gene Symbol: PUF60
  Gene Name: poly-U binding splicing factor 60KDa
  Uniprot ID: Q9UHX1
  ENST ID: ENST00000456095
  CDS Start-End: 1-1593
atggcgacggcgaccatagctctcggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaa

SEQ ID NO: 167768 - DNA, 1842 bp, Homo sapiens
  Payload ID: 13004
  Gene Symbol: PUF60
  Gene Name: poly-U binding splicing factor 60KDa
  Uniprot ID: Q9UHX1
  ENST ID: ENST00000453551
  CDS Start-End: 149-1699
cccttgcgggcgagcctggcggggttgcgttcctgtccgctagcaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaa

SEQ ID NO: 167769 - DNA, 1559 bp, Homo sapiens
  Payload ID: 13004
  Gene Symbol: PUF60
  Gene Name: poly-U binding splicing factor 60KDa
  Uniprot ID: Q9UHX1
  ENST ID: ENST00000527197
  CDS Start-End: 18-1559
gccgcgacggacgcaagatggcgacggcgaccatagctctcggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtga

SEQ ID NO: 167770 - DNA, 819 bp, Homo sapiens
  Payload ID: 13004
  Gene Symbol: PUF60
  Gene Name: poly-U binding splicing factor 60KDa
  ENST ID: ENST00000532884
  CDS Start-End: 1-819
tctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgaggcagggagccaaggcctcgatcccgcaggcgtgcagggctgcccctccacggaagccttttgtggccgggcctgggttgaccggtctttccatctcaccgcctcttccccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcc

SEQ ID NO: 167771 - DNA, 1003 bp, Homo sapiens
  Payload ID: 13004
  Gene Symbol: PUF60
  Gene Name: poly-U binding splicing factor 60KDa
  ENST ID: ENST00000526459
  CDS Start-End: 36-1003
tgggaggcgcgcgcggaggccgcgacggacgcaagatggcgacggcgaccatagctctcgtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggtgagggcccacac

SEQ ID NO: 167772 - DNA, 761 bp, Homo sapiens
  Payload ID: 13004
  Gene Symbol: PUF60
  Gene Name: poly-U binding splicing factor 60KDa
  ENST ID: ENST00000533162
  CDS Start-End: 77-761
tgggaggcgcgcgcggaggccgcgacggacgcaagatggcgacggcgaccatagctctcctctcatgggaggttgaatggagcagctgaacttggctgacagtggcctggtggggaaggaagccagaagatgcagaagggcctcccctcccatgggcatgccttctgcctggtggctgcagaatgaggccggctgcctctttgcagcaaggcaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaact

SEQ ID NO: 167773 - DNA, 2412 bp, Homo sapiens
  Payload ID: 13004
  Gene Symbol: PUF60
  Gene Name: poly-U binding splicing factor 60KDa
  Uniprot ID: Q9UHX1
  ENST ID: ENST00000526683
  CDS Start-End: 557-2236
gggtcatcggttccctggaaggagaaaaagctgccaattgaacggggcctcccggtcccagggatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaacgtccgtgtgtctgccgtcggtcctgtcaccga

SEQ ID NO: 167774 - DNA, 867 bp, Homo sapiens
  Payload ID: 13004
  Gene Symbol: PUF60
  Gene Name: poly-U binding splicing factor 60KDa
  ENST ID: ENST00000529999
  CDS Start-End: 79-867
cctgggcgcggcgtgtggcccttgcgggcgagcctggcggggttgcgttcctgtccgctagctctcatgggaggttgaatggagcagctgaacttggctgacagtggcctggtggggaaggaagccagaagatgcagaagggcctcccctcccatgggcatgccttctgcctggtggctgcagaatgaggccggctgcctctttgcagcaaggcaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaag

SEQ ID NO: 167775 - DNA, 1007 bp, Homo sapiens
  Payload ID: 13004
  Gene Symbol: PUF60
  Gene Name: poly-U binding splicing factor 60KDa
  ENST ID: ENST00000527744
  CDS Start-End: 1-1007
cgacggcgaccatagctctcgtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggtgagg

SEQ ID NO: 167776 - DNA, 785 bp, Homo sapiens
  Payload ID: 13004
  Gene Symbol: PUF60
  Gene Name: poly-U binding splicing factor 60KDa
  ENST ID: ENST00000531897
  CDS Start-End: 43-785
gatggcgacggcgaccatagctctcctctcatgggaggttgaatggagcagctgaacttggctgacagtggcctggtggggaaggaagccagaagatgcagaagggcctcccctcccatgggcatgccttctgcctggtggctgcagaatgaggccggctgcctctttgcagcaaggcaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcat

SEQ ID NO: 167777 - DNA, 1734 bp, Homo sapiens
  Payload ID: 13004
  Gene Symbol: PUF60
  Gene Name: poly-U binding splicing factor 60KDa
  Uniprot ID: Q9UHX1
  ENST ID: ENST00000620953
  CDS Start-End: 1-1593
atggcgacggcgaccatagctctcggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctg

SEQ ID NO: 167778 - DNA, 1770 bp, Homo sapiens
  Payload ID: 13004
  Gene Symbol: PUF60
  Gene Name: poly-U binding splicing factor 60KDa
  Uniprot ID: Q9UHX1
  ENST ID: ENST00000612237
  CDS Start-End: 1-1629
atggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctg

SEQ ID NO: 167779 - DNA, 1821 bp, Homo sapiens
  Payload ID: 13004
  Gene Symbol: PUF60
  Gene Name: poly-U binding splicing factor 60KDa
  Uniprot ID: Q9UHX1
  ENST ID: ENST00000620341
  CDS Start-End: 1-1680
atggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctg

SEQ ID NO: 167780 - DNA, 1748 bp, Homo sapiens
  Payload ID: 13004
  Gene Symbol: PUF60
  Gene Name: poly-U binding splicing factor 60KDa
  ENST ID: ENST00000631439
  CDS Start-End: 1-1605
caggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaa

SEQ ID NO: 167781 - DNA, 944 bp, Homo sapiens
  Payload ID: 13004
  Gene Symbol: PUF60
  Gene Name: poly-U binding splicing factor 60KDa
  ENST ID: ENST00000632477
  CDS Start-End: 1-944
gtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggtgagggcccacac

SEQ ID NO: 167782 - DNA, 760 bp, Homo sapiens
  Payload ID: 13004
  Gene Symbol: PUF60
  Gene Name: poly-U binding splicing factor 60KDa
  ENST ID: ENST00000631813
  CDS Start-End: 18-760
ctctcatgggaggttgaatggagcagctgaacttggctgacagtggcctggtggggaaggaagccagaagatgcagaagggcctcccctcccatgggcatgccttctgcctggtggctgcagaatgaggccggctgcctctttgcagcaaggcaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcat

SEQ ID NO: 167783 - DNA, 1748 bp, Homo sapiens; identical to SEQ ID NO: 167780
  Payload ID: 13004
  Gene Symbol: PUF60
  Gene Name: poly-U binding splicing factor 60KDa
  Uniprot ID: Q9UHX1
  ENST ID: ENST00000633206
  CDS Start-End: 106-1605

SEQ ID NO: 167784 - DNA, 1799 bp, Homo sapiens
  Payload ID: 13004
  Gene Symbol: PUF60
  Gene Name: poly-U binding splicing factor 60KDa
  Uniprot ID: Q9UHX1
  ENST ID: ENST00000632444
  CDS Start-End: 106-1656
caggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaa

SEQ ID NO: 167785 - DNA, 987 bp, Homo sapiens
  Payload ID: 13004
  Gene Symbol: PUF60
  Gene Name: poly-U binding splicing factor 60KDa
  ENST ID: ENST00000632085
  CDS Start-End: 1-987
gtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggtgagg

SEQ ID NO: 167786 - DNA, 806 bp, Homo sapiens
  Payload ID: 13004
  Gene Symbol: PUF60
  Gene Name: poly-U binding splicing factor 60KDa
  ENST ID: ENST00000633617
  CDS Start-End: 18-806
ctctcatgggaggttgaatggagcagctgaacttggctgacagtggcctggtggggaaggaagccagaagatgcagaagggcctcccctcccatgggcatgccttctgcctggtggctgcagaatgaggccggctgcctctttgcagcaaggcaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaag

SEQ ID NO: 167787 - DNA, 702 bp, Homo sapiens
  Payload ID: 13004
  Gene Symbol: PUF60
  Gene Name: poly-U binding splicing factor 60KDa
  ENST ID: ENST00000632399
  CDS Start-End: 18-702
ctctcatgggaggttgaatggagcagctgaacttggctgacagtggcctggtggggaaggaagccagaagatgcagaagggcctcccctcccatgggcatgccttctgcctggtggctgcagaatgaggccggctgcctctttgcagcaaggcaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaact

SEQ ID NO: 167788 - DNA, 819 bp, Homo sapiens; identical to SEQ ID NO: 167770
  Payload ID: 13004
  Gene Symbol: PUF60
  Gene Name: poly-U binding splicing factor 60KDa
  ENST ID: ENST00000632993
  CDS Start-End: 1-819

SEQ ID NO: 167789 - DNA, 1712 bp, Homo sapiens
  Payload ID: 13004
  Gene Symbol: PUF60
  Gene Name: poly-U binding splicing factor 60KDa
  ENST ID: ENST00000632796
  CDS Start-End: 1-1569
ggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaa

SEQ ID NO: 167790 - DNA, 1832 bp, Homo sapiens
  Payload ID: 13004
  Gene Symbol: PUF60
  Gene Name: poly-U binding splicing factor 60KDa
  ENST ID: ENST00000632872
  CDS Start-End: 1-1656
caggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaacgtccgtgtgtctgccgtcggtcctgtcaccga

SEQ ID NO: 167791 - DNA, 1518 bp, Homo sapiens
  Payload ID: 13004
  Gene Symbol: PUF60
  Gene Name: poly-U binding splicing factor 60KDa
  ENST ID: ENST00000634206
  CDS Start-End: 1-1518
ggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtga

SEQ ID NO: 167792 - DNA, 1259 bp, Homo sapiens
  Payload ID: 13005
  Gene Symbol: POMZP3
  Gene Name: POM121 and ZP3 fusion
  Uniprot ID: Q6PJE2
  ENST ID: ENST00000275569
  CDS Start-End: 685-1032
gctgcggcggctggagcaggcgagcggcggcggccgatagcgagtgtcagggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccgcccgcccggcgccgcgctccacaccgccctccccgccgacccatcgcgttcaccacttttacccctctctccccactcctcttctccgaccctccgggaggccttccccacgggatcgtgggactttaccagatcggtttgtaataacacctcgaagacgctatccgatccatcaggcccagtattcctgtccgggggtacttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagctgtcttgtcgacggtctcactgatgcctcttctgcattcaaagttcctcgacccgggccagatacactccagttcacagtggatgtcttccactttgctaatgactccagaaacatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaata

SEQ ID NO: 167793 - DNA, 1490 bp, Homo sapiens
  Payload ID: 13005
  Gene Symbol: POMZP3
  Gene Name: POM121 and ZP3 fusion
  Uniprot ID: Q6PJE2
  ENST ID: ENST00000310842
  CDS Start-End: 686-1249
ggctgcggcggctggagcaggcgagcggcggcggccgatagcgagtgtcagggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccgcccgcccggcgccgcgctccacaccgccctccccgccgacccatcgcgttcaccacttttacccctctctccccactcctcttctccgaccctccgggaggccttccccacgggatcgtgggactttaccagatcggtttgtaataacacctcgaagacgctatccgatccatcaggcccagtattcctgtccgggggtacttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggcctggctgacatctgtcaatgctgtaacaaaggtgactgtggcactccaagccattccaggaggcagcctcgtgtcgtgagccagtggtccacgtctgcttccctgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaata

SEQ ID NO: 167794 - DNA, 815 bp, Homo sapiens
  Payload ID: 13005
  Gene Symbol: POMZP3
  Gene Name: POM121 and ZP3 fusion
  ENST ID: ENST00000454397
  CDS Start-End: 64-815
cttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagaccgagtctcagtctgtcacccaggctagtgcaatggtgcaattttggctcactacaccctctgcctcccagattcaagcgattctcctgcctcagcctcccgagtaggtggattacaggtgtgcactgctgcacccagctaatttttgtatttttagtagagacaaggtttcaccatgtttgccaggctagtctcgaactcctgacctcaagtgatccacccaccttggcctcccaaagtgctgggattatgggcgtgagccacggtgcccggcccacctgtctggctttaacaccgttctgttttcttccaagctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacag

SEQ ID NO: 167795 - DNA, 1587 bp, Homo sapiens
  Payload ID: 13005
  Gene Symbol: POMZP3
  Gene Name: POM121 and ZP3 fusion
  ENST ID: ENST00000424818
  CDS Start-End: 706-1170
ggagccgcgatgtctccggcggctgcggcggctggagcaggcgagcggcggcggccgatagcgagtgtcagggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccgcccgcccggcgccgcgctccacaccgccctccccgccgacccatcgcgttcaccacttttacccctctctccccactcctcttctccgaccctccgggaggccttccccacgggatcgtgggactttaccagatcggtttgtaataacacctcgaagacgctatccgatccatcaggcccagtattcctgtccgggggtacttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagaccgagtctcagtctgtcacccaggctagtgcaatggtgcaattttggctcactacaccctctgcctcccagattcaagcgattctcctgcctcagcctcccgagtaggtggattacagctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggcctggctgacatctgtcaatgctgtaacaaaggtgactgtggcactccaagccattccaggaggcagcctcgtgtcgtgagccagtggtccacgtctgcttccctgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcc

SEQ ID NO: 167796 - DNA, 606 bp, Homo sapiens
  Payload ID: 13005
  Gene Symbol: POMZP3
  Gene Name: POM121 and ZP3 fusion
  ENST ID: ENST00000441393
  CDS Start-End: 1-373
ctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacaggcaacaaaaatctaagctgcttctctttcatctcagctggttcccagtggaaggcctggctgacatctgtcaatgctgtaacaaaggtgactgtggcactccaagccattccaggaggcagcctcgtgtcgtgagccagtggtccacgtctgcttccctgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaaga

SEQ ID NO: 167797 - DNA, 1490 bp, Homo sapiens; identical to SEQ ID NO: 167793
  Payload ID: 13005
  Gene Symbol: POMZP3
  Gene Name: POM121 and ZP3 fusion
  Uniprot ID: Q6PJE2
  ENST ID: ENST00000619075
  CDS Start-End: 686-1249

SEQ ID NO: 167798 - DNA, 1259 bp, Homo sapiens; identical to SEQ ID NO: 167792
  Payload ID: 13005
  Gene Symbol: POMZP3
  Gene Name: POM121 and ZP3 fusion
  Uniprot ID: Q6PJE2
  ENST ID: ENST00000615241
  CDS Start-End: 685-1032

SEQ ID NO: 167799 - DNA, 815 bp, Homo sapiens; identical to SEQ ID NO: 167794
  Payload ID: 13005
  Gene Symbol: POMZP3
  Gene Name: POM121 and ZP3 fusion
  ENST ID: ENST00000631876
  CDS Start-End: 64-815

SEQ ID NO: 167800 - DNA, 1587 bp, Homo sapiens; identical to SEQ ID NO: 167795
  Payload ID: 13005
  Gene Symbol: POMZP3
  Gene Name: POM121 and ZP3 fusion
  ENST ID: ENST00000633323
  CDS Start-End: 706-1170

SEQ ID NO: 167801 - DNA, 606 bp, Homo sapiens; identical to SEQ ID NO: 167796
  Payload ID: 13005
  Gene Symbol: POMZP3
  Gene Name: POM121 and ZP3 fusion
  ENST ID: ENST00000632234
  CDS Start-End: 1-373

SEQ ID NO: 167802 - DNA, 5320 bp, Homo sapiens
  Payload ID: 13006
  Gene Symbol: POM121
  Gene Name: POM121 transmembrane nucleoporin
  Uniprot ID: Q96HA1
  ENST ID: ENST00000358357
  CDS Start-End: 301-3255
gagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgatgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgta

SEQ ID NO: 167803 - DNA, 7011 bp, Homo sapiens
  Payload ID: 13006
  Gene Symbol: POM121
  Gene Name: POM121 transmembrane nucleoporin
  Uniprot ID: Q96HA1
  ENST ID: ENST00000395270
  CDS Start-End: 1042-4041
cgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccaggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacgggaggggacttcgcgagcagacgcgcgcgccagcgacagcagcccgccccggcctctcgggagccgtggggcagaggctgcagagccccaggagggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagcccttcacatcctcagccgaagatctcacttcctcccagaggcctttgctgactgacccctcagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggcaacacttttgctcaccagcaagaacacagcccgaggaagggacccaataacctttcaaaacgcaaactgctgcctgcggtgagggcccagggtcttccacggagaggacaggcatcttcctttcccaccaggaaggagtgagcccggagcctctgctatgtgcaaggcggtgtgcaagcaccggctgcagctttttgctctcttctttctctttggggctgggctgggtgtgcgttctggtgctgatgctttggcctgtgaggctgagctagagaaatgtagatgttagatgtgccagtaccatcctgcgcctcccaagcatgcccccactcactcacgtcggcatctcgacccgttcaattacagcaacgaagaagccaccgctaagcgtggtcttgggggaagcccggaggcagtgctcggcacccgggaacgtgctcaggcctcggtggggccgggcaggcagggcgggagctagcctgcaagagaaacagccccaatgctgggtaagagagcagttcaccccatccccccctccacgaccctggcgcacgccctgtacctgaaggcgcccgggttctgctgcagcgcatcttgtaccatgtcttcattctcctcctggcagagggagcacatggagtagacgagccgctgcagggaagggaaagtgagcgcgtggcacagggctcgctgctggaaccctgccagggcatgcagacgcaccgggctaggtgtccctgccccgggctcctccagctgtctgctcggcatacctaaggaaaagcgtgtctcggttacacagcttcacaggctgcctcagtcctgaaatcctcgctcctgaaatcctcgcttcacagaggagaacttttgctccagggtcccaagcccattaaagtgtcagaactaagaccaaaacagatgactccaggtctaagctgctgtggacctctgagtccctcagccacgccttctcaccatctcacccgagccactgcaggaaggatccagcaggacatagtggacctcacgatagcgcggatctaagggggagaccgccaggaagtcctcctcagccagctcacagcaggagacgccagcccaggccagcagcgtggccatggatgccagccgcctggcatccaggtcaaaggcaaagatcttcctagggcagagggcagagcaggggtgagctgagcatgcatggagcagctaagggcctgtcacagctgacacagacaaccagaacatgcaggttaagccaggacacacaatattgaaacagcctatatttaaagggcccagggtcagaggtaactggcctggggtctctgccccaagggctaagggatccacatctcacacctgcagtggggaaagcttagcttggggcaaataccgtgaactactttggtgcagcaggaaagagttaagcgaaagtcatcctttcagccttcattacccactgaaaggcacaaaatcaaaccccatgtcctcctcctcctcctgtggcactcacccttggttcttcagaagagcagccaagtgactggtctttattgcctggggtggcacaggcatccatgacatgggagcctggcgggggtccagcagcatggctgggagacagctggcctggcaggcagaacacaggggccgggtaaacagagaccccaggctaggcccttcccgtgcctacacattcttcccttttctattcctcttgcctaccctgtcctgcagaatgaggtgtccggcccggtacagtgggtgttcatgcagatctgtctgggcgggaaacaccagcagctccggcatcaaggggtccaggagaaaatgcttccccttgagggctcgtaagtcatcgaggctgccagggaagaaccattcattcatcatttcctgaatttctccctgccaggccctatttcaacggtccattcatgcaacaaatgttaccacagctatggagaaatcaacagggtgataagggaatccgggatccgcagttgagggaatgggttgtcaagccagacttatgggtcaggagccccctctactgtttaccagcagtgggagcctgggcaagtgattcaatctcaagccccactggcatctctgtaaaatagtaggtgtgaggattcaatgagccaatatatccaagatacttacgtgccacaatttaataaatgttagctattcctgttgaagcataaccttggagaaaggttactttacaggggggtgaggagtggggaagtgagagctgagctcattcttgatggatgaggagttagtcatgtgaggcgcttaggttaaaactacattcactataactcagtaaagcagtcccgcccactctccgacccatgcagaaataggcctagggagtcacatgtctcagttcagaaatctatcgaagtggcagagctggaattcaaacacaagcagccgttctctgctattccaccctggtgtccaagcaacatggtagggcagaaggaagaggatcttacaaagagtaagggaaagggagaggggcagaggctgcttctcagagccaccaaaggacaaaataagacaggtgtgagcccagtggaggaggcacggggcagagaccagccactgttgctggcacgctggtgcacgtagcactgtggcagatggacctggagaggaagcaggagggacagcacaatggagccaagaaaggacttagcatggccgggcgcggtggttcatgcctgtaatcccagcattttgggaggccaaggtgggcagatcacctgaggtcaggagtttgagaccagcctggccaacatggagaaatcccgtctctactaaaaatacaaaattagccaggcatggtgctgcatgcctgcaatcctgtagggaaaagaaagagagatcagactgttactgtgtctgtgtagaaagggaagacataagaaattccattttgacctgtaccttgaacaattggttggctgagatgctgttaatttgtgactttgccccaaatttgagctcacaaaaacatgtgttgtatggaatcaaggtttaaaggatctagggctgtgcaggacatgccttgttaataaaacgtttacaagc

SEQ ID NO: 167804 - DNA, 3456 bp, Homo sapiens
  Payload ID: 13006
  Gene Symbol: POM121
  Gene Name: POM121 transmembrane nucleoporin
  Uniprot ID: Q96HA1
  ENST ID: ENST00000446813
  CDS Start-End: 457-3456
gggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggcaacacttttgctcaccagcaagaacacagcccgaggaagggacccaataacctttcaaaacgcaaactgctgcctgcggtgagggcccagggtcttccacggagaggacaggcatcttcctttcccaccaggaaggagtga

SEQ ID NO: 167805 - DNA, 3750 bp, Homo sapiens
  Payload ID: 13006
  Gene Symbol: POM121
  Gene Name: POM121 transmembrane nucleoporin
  Uniprot ID: Q96HA1
  ENST ID: ENST00000434423
  CDS Start-End: 1-3750
atgtctccggcggctgcggcggctggagcaggcgagcggcggcggcccatagcgagtgtcagggacggccggggccggggctgcggcgggccggccagggcggtgctcctgggcctgtcgctggttggcctcttactgtacctcgtgccggctgcggctgcactggcctggctgaccgtgggggctaccgcggcctggtggggactgagccgcgagccccgaggttcgcgccccttgtcctccttcgttcggaaggcgcgtcatcggcgccccttgtcctccttcgttcggaaggcgcgtcatcggcgaacactgttcgcttcgcctctggccaagtcgacagccaacggaaacctcctagagccgcggaccctgctcgaaggacctgaccctgcggaactgctactcatgggcagttacctgggcaagcccgggccgccgcagcccgccgccgctccggagggccaggacctgcgggataggcctggccgccgcccacctgcccgcccggcgccgcgctccccaccgccgcgctccccaccgccgcgctcccccccgccctccccgccgacccatcgcgctcaccacgtttacccctctctgcccactcctcttctccgaccctccaggaggccttccccacgggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtag

SEQ ID NO: 167806 - DNA, 5480 bp, Homo sapiens
  Payload ID: 13006
  Gene Symbol: POM121
  Gene Name: POM121 transmembrane nucleoporin
  Uniprot ID: Q96HA1
  ENST ID: ENST00000627934
  CDS Start-End: 457-3411
gggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgatgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtagagt

SEQ ID NO: 167807 - DNA, 715 bp, Homo sapiens
  Payload ID: 13007
  Gene Symbol: POM121C
  Gene Name: POM121 transmembrane nucleoporin C
  ENST ID: ENST00000398379
  CDS Start-End: 589-715
cttatgcaggtgatttctgcctttgcaggccggagccctcatgacttcagtgacctgcttctgcccctctaggtctatcagccacagtctctgcatgtttccaagagcagcagaaaatgaacacattgcaggggccagtgtcattcaaagatgtggctgtggatttcacccaggaggagtggcggcaactggaccctgatgagaagataacatacggggatgtgatgttggagaactacagccatctagtttccttggcttatgaggtggcaacatcttgtacttcggagattctgaagccgagcaacttgcccaagtccttcttcttttcccattaacaagatatgatatcaccaagccaaacgtcatcattaagttggagcagggagaggagctgtggataacgggaggtgaatttccatgtcaacatagtcctgggatcgtgggactttaccagatcggtttgtaataacacctcgaagacgctatccgatccatcagacccagtattcctgtccgggggtacttcccacagtgtgctggaatggttatcacaagaaggctgtgctgtcccctcgcaactccaggatggtgtgtagcccagtgactgtgaggatcgcccctcctgacagaagattttcacgttctgcgataccagagcagataatcagctcaacactgtcgtcaccatcaagtaatgccccagacccatgtg

SEQ ID NO: 167808 - DNA, 575 bp, Homo sapiens
  Payload ID: 13007
  Gene Symbol: POM121C
  Gene Name: POM121 transmembrane nucleoporin C
  ENST ID: ENST00000439629
  CDS Start-End: 254-575
agcctcatgcttctgtagaaacgtgttaaaagtttattttcaagaaagaaggctctaagtcttccggtcggaattttgtggtgttcagttatttgggcgccatgatagcagtggcagtggacattcagcatttgagcccctggtggccagtggagtccccgcttcttttgtgcctaagcctgggtctctgaagagaggcctcaattctcagagctcagatgaccacttgaataagagatcccgaagctcttccatgagctccttgacaggcgcttacacaagtggcatccctagctccagccgcaatgccattaccagttcctacagctccactcgaggcatctcacagctgtggaagagaaatggccccagttcatcacccttctctagcccagcctcatcccgctcccagacaccggagaggccagcaaagaaaataagagaagaagagctgtgtcatcattccagttcttcaactccattggcagcagacaaggagtcccagggagaaaaggctgcagatacaaccccaaggaagaaacaaaactcgaattctcagtctacacctggcagct

SEQ ID NO: 167809 - DNA, 3690 bp, Homo sapiens
  Payload ID: 13007
  Gene Symbol: POM121C
  Gene Name: POM121 transmembrane nucleoporin C
  ENST ID: ENST00000607367
  CDS Start-End: 1-3690
atgtctccggcggctgcggcggctggagcaggcgagcggcggcggccgatagcgagtgtcagggacggccggggccggggctgcggcgggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccacccgcccgcccggcgccgcgctccacaccgccctcccagccgacccatcgcgttcaccacttttacccctctctccccactcctcttctccgaccctccgggaggccttccccacgggatcgtgggactttaccagatcggtttgtaataacacctcgaagacgctatccgatccatcagacccagtattcctgtccgggggtacttcccacagtgtgctggaatggttatcacaagaaggctgtgctgtcccctcgcaactccaggatggtgtgtagcccagtgactgtgaggatcgcccctcctgacagaagattttcacgttctgcgataccagagcagataatcagctcaacactgtcgtcaccatcaagtaatgccccagacccatgtgcaaaggagactgtactgagtgccctcaaagagaagaagaagaaaaggacagtggaggaagaagaccaaatattccttgatggccaggaaaataaaagaaggcgccatgatagcagtggcagtggacattcagcatttgagcccctggtggccagtggagtccccgcttcttttgtgcctaagcctgggtctctgaagagaggcctcaattctcagagctcagatgaccacttgaataagagatcccgaagctcttccatgagctccttgacaggcgcttacacaagtggcatccctagctccagccgcaatgccattaccagttcctacagctccactcgaggcatctcacagctgtggaagagaaatggccccagttcatcacccttctctagcccagcctcatcccgctcccagacaccggagaggccagcaaagaaaataagagaagaagagctgtgtcatcattccagttcttcaactccattggcagcagacaaggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagtgatgctgcctcgaactctgtcactgagaccccacctaccactcagccttcatttacctttaccctgcctgctgctgcaactgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcatctcccatgttcaagcccattttcacggctccacccaagagtgagaaggaaggcctcacaccgcctggcccttcagtctcagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcccactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccagcccttacccccagctttggcagctctttcacttttggaaactctgcagccccggccccggctactgcacccacacctgcacctgcgtccacgatcaagatcgtgcctgcgcacgtgcctacgcccatccagcctacctttggcggtgccacgcactcggcgtttggattgaaagccacggcttccgccttcggcgctcccgccagctcacagcccgcctttggcggctccactgctgtcttctccttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaacgtggccaccccaggctccagcgccaccaccggagctttcagctttggagcaggacagagtgggagcacagccacctccacccccttcacagggggcttaggtcagaacgccctgggcaccaccggccagagcacaccgtttgccttcaacgtgggcagcacaactgagagcaaacctgtgtttggaggcaccgccacccccacctttggtcagaacacccctgcgcctggagtgggcacatcgggcagcagcctctcctttggggcatcttcagcacccgcccaaggctttgttggtgttggaccgttcggatcggcggccccttcattttccattggtgcgggatccaagaccccaggggctcgacagcgactgcaggcccgaaggcagcacacccgcaaaaagtag

SEQ ID NO: 167810 - DNA, 5835 bp, Homo sapiens
  Payload ID: 13007
  Gene Symbol: POM121C
  Gene Name: POM121 transmembrane nucleoporin C
  ENST ID: ENST00000615331
  CDS Start-End: 866-3829
gtcatcgcttgctctcgttcccaggctttggcttctagtggacgagaatcaccgagtctgcggggctggatgctgaccgcccggaccagcacctaggcgggcgggagctgtgcggcccagggttcgcgcgggccgggtagaggctcgagctgggacccccgagcgtgaaccccggagccggcggcgctggggccagaggggccgggagccccagggaggcggatctgggccccgagaaggacacccgcctggatttgccccgtaggcccggcccgggcccctcgggagcagaacagccttggtgaggtggacaggaggggacctcgcgagcagacgcgcgcgccagcgacagcagcccgccccggcctctcgggagccgtggggcagaggctgcggagccccaggagggggccagtgtcattcaaagatgtggctgtggatttcacccaggaggagtggcggcaactggaccctgatgagaagataacatacggggatgtgatgttggagaactacagccatctagtttccttggcttatgaggtggcaacatcttgtacttcggagattctgaagccgagcaacttgcccaagtccttcttcttttcccattaacaagatatgatatcaccaagccaaacgtcatcattaagttggagcagggagaggagctgtggataacgggaggtgaatttccatgtcaacatagtcctgggatcgtgggactttaccagatcggtttgtaataacacctcgaagacgctatccgatccatcagacccagtattcctgtccgggggtacttcccacagtgtgctggaatggttatcacaagaaggctgtgctgtcccctcgcaactccaggatggtgtgtagcccagtgactgtgaggatcgcccctcctgacagaagattttcacgttctgcgataccagagcagataatcagctcaacactgtcgtcaccatcaagtaatgccccagacccatgtgcaaaggagactgtactgagtgccctcaaagagaagaagaagaaaaggacagtggaggaagaagaccaaatattccttgatggccaggaaaataaaagaaggcgccatgatagcagtggcagtggacattcagcatttgagcccctggtggccagtggagtccccgcttcttttgtgcctaagcctgggtctctgaagagaggcctcaattctcagagctcagatgaccacttgaataagagatcccgaagctcttccatgagctccttgacaggcgcttacacaagtggcatccctagctccagccgcaatgccattaccagttcctacagctccactcgaggcatctcacagctgtggaagagaaatggccccagttcatcacccttctctagcccagcctcatcccgctcccagacaccggagaggccagcaaagaaaataagagaagaagagctgtgtcatcattccagttcttcaactccattggcagcagacaaggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagtgatgctgcctcgaactctgtcactgagaccccacctaccactcagccttcatttacctttaccctgcctgctgctgcaactgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcatctcccatgttcaagcccattttcacggctccacccaagagtgagaaggaaggcctcacaccgcctggcccttcagtctcagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcccactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccagcccttacccccagctttggcagctctttcacttttggaaactctgcagccccggccccggctactgcacccacacctgcacctgcgtccacgatcaagatcgtgcctgcgcacgtgcctacgcccatccagcctacctttggcggtgccacgcactcggcgtttggattgaaagccacggcttccgccttcggcgctcccgccagctcacagcccgcctttggcggctccactgctgtcttctccttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaacgtggccaccccaggctccagcgccaccaccggagctttcagctttggagcaggacagagtgggagcacagccacctccacccccttcacagggggcttaggtcagaacgccctgggcaccaccggccagagcacaccgtttgccttcaacgtgggcagcacaactgagagcaaacctgtgtttggaggcaccgccacccccacctttggtcagaacacccctgcgcctggagtgggcacatcgggcagcagcctctcctttggggcatcttcagcacccgcccaaggctttgttggtgttggaccgttcggatcggcggccccttcattttccattggtgcgggatccaagaccccaggggctcgacagcgactgcaggcccgaaggcagcacacccgcaaaaagtagcctttgtcccctgtccctgttccccccaccccttccctaaatctggaccttggcacgtgctagaaagagccttggacccttccagctgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttccactggggaggctggagaactaaggacctgtacatagtgtccgctgccctgactcccgcttagcgcacccttaggcaggcgccccttccacctttccccgagagccgtcgtcgctggagggggcagggtccagcccgcctggatcggtggtgtgcacctgatgggatttgggaaatgggttatccctaaagctttatcttgcttggcttagctgtgagaagtggttctcttcctctggtcccttctggggactctgtttccccatttcttgctgctgtgtccctcaccggttccttgcaggattccctcctttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccactgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgcggtttctgtcccacttaactgacctcactggaggctacgtcacccaaagtagatgttagaaaacctaaattaatgaaccatatttttaaaatcctatttttcccaaacagggccctctgcagcccatcctttccttccgtccttctgaaaccacataccccaggcccaagcgccttgctgtcacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtagatgtaaccggtgccccctccccgttgtgactgagggcgagtgttatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagcttgtttacctcagttccgcaggcaggacagccggtccgggaaccctgagtgagagtgagtgtggatgtgtacagtacacacactggacggcagcgggaggctgggactttccattacaaatagagacttcattcctgttgagtctagttggaatttttagtatgaatgtgagatttttctcctgcttgtgacattaagaataaaaaactgtgatctat

SEQ ID NO: 167811 - DNA, 1283 bp, Homo sapiens
  Payload ID: 13008
  Gene Symbol: POM121L12
  Gene Name: POM121 transmembrane nucleoporin-like 12
  Uniprot ID: Q8N7R1
  ENST ID: ENST00000408890
  CDS Start-End: 31-921
aagcgcccagaggccaacggtcccccagccatgggcgctgcagctccggccgagtccgcagacctcgggaacttctggaaggcgggagaacccctgctgcaaggccccgacgccctggcggctcccatgagcaggtcacccagcacgccccagaccacgccatctccccagggtcgccagagtccctggcccctgaggtccctgactcagagccatattcagtacttccagtgggggcgcccggtgcccagcacccacctcatcgaggtgcggcccacccaggaccccgccaagccgcagcgggtggtctccgagggctggaggcgccctgcccttcccggggagaccgctctggggcgagacctctcctgtgcctgggagggttgcatgaaaggggggctgtgtcgtgcctggaacccaggacggacctggagcccggtgaccatcgggatcgcgccccctgagcgtcaggagagcccctggagatcccctggacagagagcccgccccgcaggccgccccgccgcccaggagctcctggacccctgcacccgggagactctgctgggggcgctcagccagtgccccaagggaagcgctaggttcgacgggccgttgtggttcgaggtctcagacagcaagggtggcaggcggaacctgcagccccggccctctgccttcaagcccctgagcaaaaatggagcggttgcttccttcgtgcccaggccagggcctctgaagccgagcctcggcccctggagcctcagtttttgtgatgatgcttggccttccgtgctggtccagcccgccccatccgccatctgggacttctgggaggcgacaacgccttcctgcggcagctgcagtagggtctccttcgccctcgaggtcacccagtctgctggcccctttggctcctaagaatctgggctctgctacccacctccggagacacaagcccacgtatctactttcacttgctcatccttgctctacctcaacgtggggccctgacaccacgttatcaaacatgcagcccccacacccctcgtctgcccgcccccagatcttccctctgtgctccctgccaccccagcagctgttgatttcagaacccttgccttcgccctgctggccctctcctccctgcccttcttcctgcccttcctctgaaaagaggcatttcgggaaggcttgctttttctccatgtctcccagtttgtatagttaaattgtccagttgtatagttaaatatttgatcttattaaaaacatttgtctgc

SEQ ID NO: 167812 - DNA, 3108 bp, Homo sapiens
  Payload ID: 13009
  Gene Symbol: POM121L2
  Gene Name: POM121 transmembrane nucleoporin-like 2
  Uniprot ID: Q96KW2
  ENST ID: ENST00000444565
  CDS Start-End: 1-3108
atgggcagtttcctgagcaaactggaactttcgccctcgtccccagcccaggtgcgcaccgacttgcccgagaggcccacgaaacgccggccacctcagccccttcaccaagttcatcgggttcagttcgtccaccgcgcccaccctgccccacggtatagacctgtgaggaggcggccaaacctggatcctgccaatccaaccacgtggctggccaacgaggcctggaggcgctttcccatgaagaagtcccagaattcccccctggggcctctcccttcagactggtgggaaagttacttaaagcggactatttggtctcttcgacatcccaggccaatttggagcccagtgaccatcaggatcactcctcctgaccagagagtgcccccttccacttctcctgaagatgtaattgcccttgcaggactcccgccctctgaggagctcgcagatccatgttcaaaggagacagtgttgagggccctcagagagtgcagaaaagggaaagggaggttggaagaaccactattccctgagagtctggacagtaagagaaggagtccagagaccagaccatcggcatttaagcccctgatgaaaaatggaaccctcacttcttttgtgcccaggcctgggccgctgaagagaagtctccactcctggggctcagatcacagcttgactaagaggcccaattgctcctccatgagctccttggccagcatatacagaggtggcaccctcagctccaaaaggaatgctattggcagctcttacagctcttgcagaaatttctcagacccttggaagagaagtgttcccagtgtatcattcgagacaccagagtggccaataaaaaaggaaaaaagttgtcatcggccttcctctccagtcccactggtatcagattttgagtccctaggaggatctgaaagttctgggcagcaaaaccagaagattccacagctgccgtctagccctgagaacctggtgtcagagatcccacctccccagcttggttatgcagtctctgatgagaacttgactttggggaagaaagctgagctacaggtaagcaacaacgcaggagaagatacaactgaggtcaacacagaccctttccctgagacttggcttgctattcagccttccttgtctcttgctctgccttcttcagaaacagatctaacccagggagcaaatcctcagttggaaaacttaagaaaaatgcagaagtctctaggtccactggcctctccacagtccacgggagaggcaaccagtgtggcccattctcctttgaagacacccagcctaccgaccccacctgggtgctcacagtcagagctccttccaggcacctctccagactcaaagcccacagctactttcatcctgctgacccccacctctcccacattaccagttactgacaccacctggccgccttcaacctctcaggctgacaggtctcccatgcccccagacccacctgcaccacccaccatccaaagtactttgcttggaatggtgagtagcccaacatcccatctttctgcatctgcacctcctgatgcaacttctgctcacctcatgttaaaaccgattttggggcccctgcacaacagcgagattggaagctcctcatattccagaatttcagtcacagctgcagcatcttcaatctcttccctttccacaattcagggtaccttaactcctaccttcaagcctatctttggcagcatagatccacttaaaactacgcccatgatagctcctttctcctccaagcagacccctcctccatttactcatgcttctacccatcatttccatggcctggtcaaggccacctctgtggtcatgtccaccaccctagccagcacatctaaagactctgtttttaagccacctttggattttggtgtagtgaatgtcaccagtgccgtaggcaacacttattctgtcccttccacttgcgacactttcctgcttgggactgctcaggccttcagggccgacttcaccccagccacaggattcattttcccaccacaccaccatcctacaattcctactgtgcatacagtcaccatgtttacccaggtcctttccagtgttgtacagatatcccctagaagcagcactgctaatttcaggggtatgggcagccctctgcctgcctctgccctagtatccacaaactggcttgcatcaacccccagcatctccaacctgactccagcaatcacaagtcccttgggatcaagctcaaggccacctttcccactatcccaaggagctaatccccagcctgcatttggtgccacaaatggacagaaacaagggccttcccagccagcccttatgccaagtgtcagtagttcttttctttttgggagctcagcagtggcattgccaacccccatgccaactccagctcagccagccttcattagtaccacacagtcagccttggggtgtttgacaccctcagcctccacctctcaaacccctgccagcacctggtcaggcattggcggcattccagcaggttttcccattagtcaagctagtacaactgggtttagaattgtaattcagacccaccaaagtggggcttttggctcagtgtttggcagcagagctccacaacctttcacttttgggggattcgtgacccctatggactgtgatgagtctgggatcataatgactggtccagacatgagccccacctctggagctttcagcattggagcattgcctagtgggaccactaacaccatgatcccctttggaaaaggctggagccagaacactgaaggcctgcccagccaccgcacagctttttccttggggagaggcagcatttctgcaagaaagactatggcccccattgctcaaaacaccccagtccctggacaagctaaggcaggcagcagtgttggctttgggatgccttttccacctgcccagggctctgttgggagaggaccttttagatcatcagcctcttcattttccattggcgcaaaatcaaaaaccccaaagaatcgggagaaagggcattcccgaaggcatcatgcctacaagaagtag

SEQ ID NO: 167813 - DNA, 462 bp, Homo sapiens
  Payload ID: 13009
  Gene Symbol: POM121L2
  Gene Name: POM121 transmembrane nucleoporin-like 2
  ENST ID: ENST00000429945
  CDS Start-End: 1-279
aaaaaggaaaaaagttgtcatcggccttcctctccagtcccactggtatcagattttgagtccctaggaggatctgaaagttctgggcagcaaaaccagaagattccacagctgccgtctagccctgagaacctggtgtcagagatcccacctccccagcttggttatgcagtctctgatgagaacttgactttggggaagaaagctgagctacagcatttcccgggtatctggaaggtgctcaacagtgagatggtgctcttcctccaaatctgttgacatgacaggacagtgccgcttatgaatctctgacaaatagcaaagtggaaaattcctgctcttggcagctaaaacttggattgatcacaatatttcaggaaacagagaagaaagacagtatttcccagttagcaagatcttgagtcttatgatttttttctgacattaaatctgcagcataaa

SEQ ID NO: 167814 - DNA, 2404 bp, Homo sapiens
  Payload ID: 13010
  Gene Symbol: POM121L7
  Gene Name: POM121 transmembrane nucleoporin-like 7
  ENST ID: ENST00000329949
  CDS Start-End: 428-1816
ggcggctggacgaggacgctcagagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcctgtgggatctccccgttgctcctgcccgtggactgagtggcaggccatcctacaagcacccggacacttgacatcagtggtgtcaagacaactctaagaaggttttccgtgatcctgcaagccctgccttccttcctgggatcctgccttcaatttgattgcacaggtaccacagcaagccagtgctgtgtgctccgagttccagggcgtcctccagctcagccactgcactgagaacatggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatggaggcctctctccctttgtgcccgggcccgggcctctgcagacagacctccatgcccagaggtcagaaatcagatataaccagacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcgccctcaggaatgactcctccacatccgaggcctctaggcccagtacacacaagtttcccctgctgccacgcaggcgaggggagcctttgatgctgccacctcccttagagctggggtaccgggtcactgttgaagaccttgaccgggagaaggaggcggcattccagcgcatcaacagtgcactgcaagttgaggacaaggccatctcggactgcagaccctcacggccttcccacactttgtcctcacttgcaacaggggcttctggtctgcctcccgtttctaaagcacccagtatggatgcacagcaggagacacacaagtcccaagactgcctgggcctactggcccccttagcatctgctgcaggggtcccctctacagctcccatgtctgggaagaagcacagaccaccaggccccctgttctcctcctcagatccccttcctgccacctcttcccattcccaggactcagcccaggtcacctcgctgattcctgcccccttcccagctgcaagcatggatgcgggcatgagaagaacaaggtgtggcacttctgctcctgcagctgccgcagcagcccctcccccctccacattgaaccccacgttggggtcactactggagtggatggaggcccttcacatttctgggcctcagccacagctgcagcaggtgcccagaggtcagaaccagagatcccagacctcccggaccagctcgtgccccaaacgaaatgccatctcgagcccctaccgctctacgggaggcctcccggaacgaaagcggagaagggggccagcctcatcccactgccagctgaccctcagttcctgaaacacagtgagtgaggacggacctcaggctgtctcttcaggtcacacccagtgtgaaaagatggcagatacagcaccagggcagacactcgcccccaggggtggctcccccagatcccaggcctctaggccctgtagatgcaagtttcccctgctgccacgcaggcgaggggagcctttgatgctgccacctcccttagagctggggtaccgggtcactgctgaagacctggaccaggagaaggaggcggctttccagcgcatcaggagtgcactgcaggttgaggacaaggccatttagtactgcagaccctcacggccttcccacactttgtcctcacttgcaacaggggcttctggtctgcctgccatttctaaagcacccagtatggatgcacagcaggagagacacaagtcccaagactgcctgggcctagtggccccccagcatctgctgcacaggcctgtagtcccagctactcaggaggctgaggcaggagaacggcataaacccgggaggcagagcttgcagtgagctgagatcgcgccactgcactccagcctgggtgacagagcgagactccgtctc

SEQ ID NO: 167815 - DNA, 3244 bp, Homo sapiens
  Payload ID: 13011
  Gene Symbol: POP1
  Gene Name: POP1 homolog, ribonuclease P/MRP subunit
  Uniprot ID: Q99575
  ENST ID: ENST00000349693
  CDS Start-End: 29-3103
gtgatctggaatggcccagatcccttaaatgtcaaatgcaaaagaaagaaaacacgccaagaaaatgagaaaccagcctaccaatgtgactctgtcctctggctttgtggctgacagaggtgtaaagcaccacagtggaggtgaaaaacctttccaagctcaaaaacaagagcctcatcctggaacttcacgacagcggcaaaccagagtcaacccccattctctgcctgaccctgaagtgaatgagcagtcttcctccaaagggatgtttagaaaaaagggaggatggaaagcaggtcccgagggcacgtctcaggagatccccaagtatataactgcttctacttttgctcaagcacgagctgctgaaatcagtgctatgttaaaagctgtgacccagaagtcttcgaattcactggtttttcagactctgccacggcacatgcgacgaagagccatgagccacaacgtcaaacgccttcccagacggttacaggagattgcccagaaagaggcggagaaagccgtacatcagaaaaaagaacattcaaaaaataaatgccataaagctcgaagatgtcacatgaaccggacgctagaatttaaccgtagacaaaagaagaacatttggttagaaactcacatctggcacgccaagcggtttcatatggtcaagaagtggggctactgccttggggagaggccaacagtcaagagccacagagcctgctatcgagccatgacgaaccggtgcctcctgcaggatttatcctattactgttgtttggagttgaaaggcaaagaggaagaaatactaaaggcgctttctggaatgtgtaacatagacacagggctgacgtttgcagcagttcactgcttgtctggaaagcgccaagggagccttgtgctttatcgggtgaataaatatcccagagaaatgcttgggcctgttacgtttatctggaagtcccagaggaccccgggtgacccttctgagagcaggcagctgtggatctggctgcatccaacccttaaacaggatatcttagaggaaataaaagcagcgtgccagtgtgtggaacccatcaaatcagctgtctgcatcgctgacccacttccaacaccatcccaagaaaaaagccaaactgaattgcctgacgagaaaattggcaagaaaagaaaaaggaaagatgatggagaaaatgctaaaccaattaaaaaaattatcggtgatggaactagagatccatgtctaccatactcttggatctctccaaccacaggcattataatcagcgatttgacgatggagatgaacagattccggctgattgggccactttcccactccatcctaactgaagcaataaaagctgcttctgtccacactgtgggagaggacacagaggagacacctcaccgctggtggatagaaacctgtaagaaacctgacagcgtttcccttcattgcagacaagaagccattttcgagttgttgggaggaataacatcaccagcagaaattccggcaggtactattctgggactgacagttggggatcctcgaataaatttgccccaaaagaagtccaaagctttgcccaatccagaaaaatgccaagataatgagaaagttagacagctgcttctggagggtgtgcctgtggaatgtacgcatagctttatctggaaccaagatatctgtaagagtgtcacagagaataaaatctcggatcaggatttaaaccggatgaggagtgaattgctggtgcctgggtcacagcttattttaggtccccatgaatccaagatacctatacttttgattcagcagccaggaaaagtgactggtgaagatcgactaggctggggaagtggctgggatgtcctactcccaaagggctggggcatggctttctggattccatttatttatcgaggtgtgagagtcggagggttgaaagagtctgcagtgcattctcagtataagaggtcgcctaatgtcccaggcgattttccagactgccctgccgggatgctgtttgcggaagagcaagctaagaatcttcttgaaaagtacaaaagacgccctcctgcaaaacggcccaactacgttaagcttggcactctggcacctttctgctgtccctgggagcagttaactcaagactgggagtcaagagtccaggcttacgaagaaccttctgtagcttcatctccaaatggtaaggagagtgacctaagaagatctgaggtgccttgtgctcccatgcctaaaaaaactcatcagccatctgatgaagtgggcacatccatagagcaccccagggaggcagaggaggtaatggatgcagggtgtcaagaatcggcagggcctgagaggatcacagaccaggaggccagtgaaaaccatgttgctgccacagggagtcacctctgcgttctcaggagtagaaaattactgaagcaactgtcagcctggtgtgggcccagttctgaggatagtcggggaggccggcgagctcccggcagaggccagcaaggattgaccagagaggcttgcctgtccatcttgggccacttccccagggccctggtttgggtcagcctgtccctgctcagcaagggcagccccgagcctcacaccatgatctgtgtcccagccaaggaggacttcctccagctccatgaggactggcattactgtgggccccaggaatccaaacacagtgacccattcaggagcaagatcctgaaacagaaagagaagaagaaaagggagaagaggcagaagccaggacgtgcctcttctgatggcccggcgggggaagagcccgtggctgggcaggaagctctgactctagggctgtggtcaggccctctgccgcgtgtgacgttgcactgctccagaactctcctaggctttgtgactcagggagatttttccatggctgttggctgtggagaagccctggggtttgttagcttgacaggcttgctggatatgctgtccagccagcctgcagcgcagaggggcttagtgctactgaggcctcccgcctctctgcagtatcgatttgcgaggattgctattgaggtgtgaatgcgtgcttgtatcccagcagggcatagataatacgttattattgtctgccaagttctacatgtggagaatctgcttctgctttaaaatatcatgtgaaactccctggaaacaagaataaaaaattatgtattatgcaga

SEQ ID NO: 167816 - DNA, 4719 bp, Homo sapiens
  Payload ID: 13011
  Gene Symbol: POP1
  Gene Name: POP1 homolog, ribonuclease P/MRP subunit
  Uniprot ID: Q99575
  ENST ID: ENST00000401707
  CDS Start-End: 82-3156
ctccaggagctttggctcggtgggtactgtcgcggaggcttgtcattctgacccggggattcctcacagcgtctggcagaaatgtcaaatgcaaaagaaagaaaacacgccaagaaaatgagaaaccagcctaccaatgtgactctgtcctctggctttgtggctgacagaggtgtaaagcaccacagtggaggtgaaaaacctttccaagctcaaaaacaagagcctcatcctggaacttcacgacagcggcaaaccagagtcaacccccattctctgcctgaccctgaagtgaatgagcagtcttcctccaaagggatgtttagaaaaaagggaggatggaaagcaggtcccgagggcacgtctcaggagatccccaagtatataactgcttctacttttgctcaagcacgagctgctgaaatcagtgctatgttaaaagctgtgacccagaagtcttcgaattcactggtttttcagactctgccacggcacatgcgacgaagagccatgagccacaacgtcaaacgccttcccagacggttacaggagattgcccagaaagaggcggagaaagccgtacatcagaaaaaagaacattcaaaaaataaatgccataaagctcgaagatgtcacatgaaccggacgctagaatttaaccgtagacaaaagaagaacatttggttagaaactcacatctggcacgccaagcggtttcatatggtcaagaagtggggctactgccttggggagaggccaacagtcaagagccacagagcctgctatcgagccatgacgaaccggtgcctcctgcaggatttatcctattactgttgtttggagttgaaaggcaaagaggaagaaatactaaaggcgctttctggaatgtgtaacatagacacagggctgacgtttgcagcagttcactgcttgtctggaaagcgccaagggagccttgtgctttatcgggtgaataaatatcccagagaaatgcttgggcctgttacgtttatctggaagtcccagaggaccccgggtgacccttctgagagcaggcagctgtggatctggctgcatccaacccttaaacaggatatcttagaggaaataaaagcagcgtgccagtgtgtggaacccatcaaatcagctgtctgcatcgctgacccacttccaacaccatcccaagaaaaaagccaaactgaattgcctgacgagaaaattggcaagaaaagaaaaaggaaagatgatggagaaaatgctaaaccaattaaaaaaattatcggtgatggaactagagatccatgtctaccatactcttggatctctccaaccacaggcattataatcagcgatttgacgatggagatgaacagattccggctgattgggccactttcccactccatcctaactgaagcaataaaagctgcttctgtccacactgtgggagaggacacagaggagacacctcaccgctggtggatagaaacctgtaagaaacctgacagcgtttcccttcattgcagacaagaagccattttcgagttgttgggaggaataacatcaccagcagaaattccggcaggtactattctgggactgacagttggggatcctcgaataaatttgccccaaaagaagtccaaagctttgcccaatccagaaaaatgccaagataatgagaaagttagacagctgcttctggagggtgtgcctgtggaatgtacgcatagctttatctggaaccaagatatctgtaagagtgtcacagagaataaaatctcggatcaggatttaaaccggatgaggagtgaattgctggtgcctgggtcacagcttattttaggtccccatgaatccaagatacctatacttttgattcagcagccaggaaaagtgactggtgaagatcgactaggctggggaagtggctgggatgtcctactcccaaagggctggggcatggctttctggattccatttatttatcgaggtgtgagagtcggagggttgaaagagtctgcagtgcattctcagtataagaggtcgcctaatgtcccaggcgattttccagactgccctgccgggatgctgtttgcggaagagcaagctaagaatcttcttgaaaagtacaaaagacgccctcctgcaaaacggcccaactacgttaagcttggcactctggcacctttctgctgtccctgggagcagttaactcaagactgggagtcaagagtccaggcttacgaagaaccttctgtagcttcatctccaaatggtaaggagagtgacctaagaagatctgaggtgccttgtgctcccatgcctaaaaaaactcatcagccatctgatgaagtgggcacatccatagagcaccccagggaggcagaggaggtaatggatgcagggtgtcaagaatcggcagggcctgagaggatcacagaccaggaggccagtgaaaaccatgttgctgccacagggagtcacctctgcgttctcaggagtagaaaattactgaagcaactgtcagcctggtgtgggcccagttctgaggatagtcggggaggccggcgagctcccggcagaggccagcaaggattgaccagagaggcttgcctgtccatcttgggccacttccccagggccctggtttgggtcagcctgtccctgctcagcaagggcagccccgagcctcacaccatgatctgtgtcccagccaaggaggacttcctccagctccatgaggactggcattactgtgggccccaggaatccaaacacagtgacccattcaggagcaagatcctgaaacagaaagagaagaagaaaagggagaagaggcagaagccaggacgtgcctcttctgatggcccggcgggggaagagcccgtggctgggcaggaagctctgactctagggctgtggtcaggccctctgccgcgtgtgacgttgcactgctccagaactctcctaggctttgtgactcagggagatttttccatggctgttggctgtggagaagccctggggtttgttagcttgacaggcttgctggatatgctgtccagccagcctgcagcgcagaggggcttagtgctactgaggcctcccgcctctctgcagtatcgatttgcgaggattgctattgaggtgtgaatgcgtgcttgtatcccagcagggcatagataatacgttattattgtctgccaagttctacatgtggagaatctgcttctgctttaaaatatcatgtgaaactccctggaaacaagaataaaaaattatgtattatgcagatgatgaaatgtttacatcattccagtaatgtcattgattttcatctttccctgtccttgctgtaatacttttaaattatttggccaaaagctttgtattatgatctcttggtctgtgtagttgtggctgaaaataatgagaagctctacgagttatcatcccctttttttgttagaaacaaagggcttgtcaggtctatttgaaaaacctcatagtcatgtgataagcaacaatagatgtttaatgatttcactgttatagcagaagacaagagaagacgcttggcctctgtacatgaaatatgggctcctgatggacctcattcaattctgtactgtgatttccatgccgaacaactcaagccttaaagagagaaatcatggacaactgatttctgcctgttttcaggcaggcacagtttatggcgtcagtgctaggctggaattagaaagtgggggtctatgacgtggacttcctgactctttgatctctttgttgttgaccaacacttgatcctactagttacttaatttttttaagtaaaaaattattattattttgtttctgcaaagattttctcaaagccatagaggagcatttctcagaatatgttctatgatatgtgtcacctaaaaaagtaagagattccaaggtcaggttgatatggaaactctaggttaaataaagttaagcatttctttatgaaagaacttctggaaacttccatgtgataatgtgcattgcggatctctaggaaggaaatgatagtgtatagtattttctaaatacttgtgattcctaaagttctcttacaaggagccctttgtaggaccagtgttcttagtagcgcgctttgggcagtgtggctgtgtagtgcatagctacctctgcaaggtgataactaagccggcaagctgcctttcaacactcatgcagtcacgttgtccacctgagattctcaacagggtataaaaggaaggtctcatcttgcctcacaggaagagtgggctcagtgtggcttttttccaactatggagaaactcagtgctcatctactttaagtttccacatatggcttgctcatagccttggtccttacctttcctgccataactttctagaagagcttaatgggattttttttctaaaaaatgtaaatatgcagttaggcattattttatgtaaatgcattgggtttttactgtagcatttggcactaaatggctttgggggtgatgaggtggggaaggatacagcaggtggtacagtagtcaggaagtacctgccaccaatgagatgtctgatgctttgcctcttaccatgcctctgaatgtctttggatccaacccagatgagactgaaaaaaaaaaaacagtgtaactaagtggcatctgtaaacagaataaatgaaaatgtcacctg

SEQ ID NO: 167817 - DNA, 585 bp, Homo sapiens
  Payload ID: 13011
  Gene Symbol: POP1
  Gene Name: POP1 homolog, ribonuclease P/MRP subunit
  ENST ID: ENST00000522319
  CDS Start-End: 37-585
gctctccagcgcgctctccaggagctttggctcgaaatgtcaaatgcaaaagaaagaaaacacgccaagaaaatgagaaaccagcctaccaatgtgactctgtcctctggctttgtggctgacagaggtgtaaagcaccacagtggaggtgaaaaacctttccaagctcaaaaacaagagcctcatcctggaacttcacgacagcggcaaaccagagtcaacccccattctctgcctgaccctgaagtgaatgagcagtcttcctccaaagggatgtttagaaaaaagggaggatggaaagcaggtcccgagggcacgtctcaggagatccccaagtatataactgcttctacttttgctcaagcacgagctgctgaaatcagtgctatgttaaaagctgtgacccagaagtcttcgaattcactggtttttcagactctgccacggcacatgcgacgaagagccatgagccacaacgtcaaacgccttcccagacggttacaggagattgcccagaaagaggcggagaaagccgtacatcagaaaaaagaacattcaaaaaataaatgccataaagctcgaaga

SEQ ID NO: 167818 - DNA, 2321 bp, Homo sapiens
  Payload ID: 13012
  Gene Symbol: POP4
  Gene Name: POP4 homolog, ribonuclease P/MRP subunit
  ENST ID: ENST00000221770
  CDS Start-End: 174-464
agagagcgccggaagcggtccgagaatgaagagtgtgatctaccatgcattgtctcagaaagaggcgaatgactccgatgtccagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacagtacatatgtggacataaacagggatcaaataaaggaggtattgctgcagtccagccaggttgaaagggaaggggggtccccaaaggtccattggatggcaggtgtctacagaggctcgcctttgggtggaactctgacccacctaaggtttactttgctatttcaggaaggttgaagaggattgaagggtgagttgctaagtgacttagggtttattcacttcaggaatcatagctggggtggaccccaggagcagagtactgcatgcagctgtgcccatgcatggttgccccagcgtagtgagatgggacctgccgcagcatgcccactcctgagctgccaggctgagccatggaggactgaaaggaggtcgcccggcatcacctcccgaggtgagacctgctgcaaaagccaagccagcagcattgacgccctttgatatcttcgccatttttgctgctgaaagacttggcttttcagtctgaccctggccctctgtgaccatgtgtctgtaaagccagtgggtcaggcccttccatgcagggccagaggaaaagcgggcccagggctgcagtgagagcggggcaggggaccagcctaccagatgggttggaaacatggctcagaaggaccaactaccccttccctttgaggagcaagtctctgccgatcagcaaggcaaggccaggagccctcctggcgaaaggcaggccacaaatctgttctcccccaggagaagtagcagtgccagggctttgcgtttctggtaacttccacccaaaccacaccagagagaaacaccgtagtggagaagggaagtgggagcgctgactgctgtgtgccaggagagtagaaaggcccaggtctgtgccaccacccctccccaaagctcagtgcacccagagtctcacagggaccaacacggtgcctcggtcctgcttccatccatgcaagtgtcctccgctcaccagggtgttctgaggcagctcaagtgctctcccccaagcagcacgcagtcaccgctgccagtgatgaacacacgcacgggctaggcacatggagcccaagcacactgccacctcggacacgggccccggcccagcgactgccttgtggtgtggccgtcctcatctgccacaggaagacagacttcgagggacctcttgcctaaggcctcgctgactcaagggtagattgagatttggacctaataggctccagaactgtgctttgagctacagggtggctgcaggatgagacggatgcagttcaaagtgcaggatgtgctgcctttattacctgctttcccgctgagcaaatccctgtcttgagtgggaagtggcatctattcccccagccatctgaaaatgctgtgttcataaccaaataggtgctgtagcttcctagccatcccgctcttacccgcccctctgcaatgtaaaaggcgtccactgttgtgtaaatacacagttgctttccagaaaa

SEQ ID NO: 167819 - DNA, 3385 bp, Homo sapiens
  Payload ID: 13012
  Gene Symbol: POP4
  Gene Name: POP4 homolog, ribonuclease P/MRP subunit
  Uniprot ID: O95707
  ENST ID: ENST00000585603
  CDS Start-End: 2303-2965
gtttgctttttaaaaaatattttaggctgggcgcagtggctcacccctgtaatctcagcactttgggaggccgaggcgggtggatcatgagatcaggagttcgagaccaacctgaccaacatggtaaaaccctgtctctactaaaaatacaaaaattagctgggcgtggtggtgtgtgcctgtaatctcagctactcaggaggctgaggcaggagaatcacttcaacctaggaggcagaggttgcagtgagccgagatcacaccattgcactccagcctggacaacacagcaagactccgtctcaaaaaaaaaaatattttaatgatgaaggaactatgttgtaattgcaactcaaggacgacccaccccaccaccatcagggaattcgaggggagactggcagttatccagggatcccagaaggagtcaactgggagttaagagtcctaacaaccctagaaaaaaactttcaaagacacaggtcttctcattaatctccataatcacagaggtcttgcctaaaagggccccccttgagtacacagctctgaaactggctaacatcttctgctgtctcatttgattttaaagttcacatttgtgaagggctctattgtacaacatggtgactatagttaataacagtgaatttcagttaataacctgaatttcactgagagtaggtctgaagtgttctcatcacaaaatgagtgtattagcatcgctcatagctcatttagccattacacaatgtatacacatttcaaaccatattgtataccataaatacatacaattcttattggttaattttaaaaataataaaagttctctatcagtcccataaattacaattttcaggcatctgcaaaggcagcatgttttggtttaaatgtggtctttccaaattttatacgtataaaataaatgcataagtgtactacatatgcaaaaactaatacataaattttataaagtcaatgcacgcggggtcactgggatgaaccaatttcagtgcctgcagtctaatgtttaaaatcaaaatggtacaaggtcaccaccaaagaaattgtttaagccaatgtttctcaaactaaaacctttggacatactcccagaatcccctgtaaagaaatgtatactgtactcaaagttgagaaccactgacttagcataaagggaccgtatttcttttctctcccacccagcacaggcccagtgctcagcagaaattggggctccacagttctgcccaacactgggtcactgctgagaagtctgcaccaggccttcctgcacctttccactgagcaatggagtttgtttattcatttatttatttatatggaatttatttatttattttggagacagggtctcactctgtcacccaggctggagtgcagtagcgcaatccaggttcactgcagccctaaactccttgggctcaactgatcctcccacctcagatacccgagtagttgggactacaagcacgcaccaccacgcctggataattttttttaaatgttttgtagagatggggtctcccgatgttgcccaggctggtctcgaactcctgggctcaagagatcctcccgcctgcgcctcccacggtgtgagccacctttgatcttattgctatgatttttttattgataaaaactaataaatattctgagtctcaagaaagctttctgaaactatcaaagggacccaggcggcgcatcactacctgtgaggccgaccccactcacagcacagactgcaagtgaggcttacagatgggaagtgccctaagcgaggttaaacagctagttagcagcagacacggaactagaacctaagcctgctgtcccagcttcggtgcccgtgctcacagcggaagctgcctcggctcatccgtaagggcgctgattagggacgacaaagacctcaccccaccgtccccgtcccatttccgccctcccagatccccaacctccttcgagtcctctccaagtcgcctcgcctcgctccactccaggccttagcaagcattccacatgcctttaccccaaccctactgcctgtcccccaaaagatgcaggcggaaaagaccccaggaagcgagcccactcctccccactgctcagcaacaccgcctacgacgttctcagtagccgaatccctttccaggcgcatgcgcccccgaggtgggcgagcgccggtgatgtcacgcatagcgccatctccgagctccgagagtctgcgacagcagctgccagtgcgtcatcagagagcgccggaagcggtccgagaatgaagagtgtgatctaccatgcattgtctcagaaagaggcgaatgactccgatgtccagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacagtacatatgtggacataaacagggatcaaataaaggaggtattgctgca

SEQ ID NO: 167820 - DNA, 575 bp, Homo sapiens
  Payload ID: 13012
  Gene Symbol: POP4
  Gene Name: POP4 homolog, ribonuclease P/MRP subunit
  ENST ID: ENST00000586823
  CDS Start-End: 22-150
agcgccggaagcggtccgagaatgaagagtgtgatctaccatgcattgtctcagaaagaggcgaatgactccgatgtccaggtcagttcttggcagggagtccaggagcaacagagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgc

SEQ ID NO: 167821 - DNA, 527 bp, Homo sapiens
  Payload ID: 13012
  Gene Symbol: POP4
  Gene Name: POP4 homolog, ribonuclease P/MRP subunit
  ENST ID: ENST00000590688
  CDS Start-End: 76-527
gaagagtaagcggggccgcgaagttggagagggttggggacgttaagggtcggggtcttggtactggtgggtgaaatgggtccgggctacctgttgctgcggagtcctaacagaaccgctacaggaatgggcccaccctacctaagaaaaactgagggctggagcacgggtgtgatctaccatgcattgtctcagaaagaggcgaatgactccgatgtccagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagagatacagccttttcctccctctccatgaactctggaaacagtacatcagggacctgtgcagtgggctcaagccagacacgca

SEQ ID NO: 167822 - DNA, 579 bp, Homo sapiens
  Payload ID: 13012
  Gene Symbol: POP4
  Gene Name: POP4 homolog, ribonuclease P/MRP subunit
  ENST ID: ENST00000586420
  CDS Start-End: 37-579
agtgcgtcatcagagagcgccggaagcggtccgagaatgaagagtgtgatctaccatgcattgtctcagaaagaggcgaatgactccgatgtccagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtg

SEQ ID NO: 167823 - DNA, 502 bp, Homo sapiens
  Payload ID: 13012
  Gene Symbol: POP4
  Gene Name: POP4 homolog, ribonuclease P/MRP subunit
  ENST ID: ENST00000591061
  CDS Start-End: 37-159
agtgcgtcatcagagagcgccggaagcggtccgagaatgaagagtgtgatctaccatgcattgtctcagaaagaggcgaatgactccgatgtccagccttcaggagcacagcgggccgaggccttcgtgagggccttcctgaagcgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaa

SEQ ID NO: 167824 - DNA, 913 bp, Homo sapiens
  Payload ID: 13013
  Gene Symbol: POP5
  Gene Name: POP5 homolog, ribonuclease P/MRP subunit
  Uniprot ID: Q969H6
  ENST ID: ENST00000341039
  CDS Start-End: 18-359
agagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcgggtacaataagaacatgtcagaagttcctaattcagtacaacaggagacagctgttgatcttgttgcagaactgcactgatgaaggagagcgggaagctatccagaagtctgtgacaagaagctgcttattagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggcatttagcatacttatattacagaaagggcttatggagtccatgcttggccaagtctctgttctctctctatccctagccttggtgggaagactgactccctatgtggtactagttaaacttttttttttgagacagtctcagtctatcacccaggctggagtgtagtggcccagtatcggctcactgcaacctccgcctcctgggttcaagcaattctcccacctcagccttccaagtaactgggattacagacgtgcaccaccacgtctggctaatttttg

SEQ ID NO: 167825 - DNA, 801 bp, Homo sapiens
  Payload ID: 13013
  Gene Symbol: POP5
  Gene Name: POP5 homolog, ribonuclease P/MRP subunit
  Uniprot ID: Q969H6
  ENST ID: ENST00000357500
  CDS Start-End: 37-528
ggtttgcacgccggaccggagagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcggttcgatatctcaatgcctatactggaatagtgctacttcgatgcagaaaagaattctatcagcttgtgtggtcagctcttcccttcatcacatacttggagaacaaaggacaccgttacccatgctttttcaacacattacatgtgggaggtacaataagaacatgtcagaagttcctaattcagtacaacaggagacagctgttgatcttgttgcagaactgcactgatgaaggagagcgggaagctatccagaagtctgtgacaagaagctgcttattagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggca

SEQ ID NO: 167826 - DNA, 927 bp, Homo sapiens
  Payload ID: 13014
  Gene Symbol: POP7
  Gene Name: POP7 homolog, ribonuclease P/MRP subunit
  Uniprot ID: O75817
  ENST ID: ENST00000303151
  CDS Start-End: 263-685
ggaaggggcggggcgaacggaagccgggaaggcgattcatagctcgcggggtacgggcgcgcgtgcgcactccgcagcccgttcaggaccccggcgcgggcagggcgcccacgagctggctggctgcttgcacccacatccttctttctctgggacctggggtcgcggttacttgggctggccggcgaacccttgagtggcctggcggggagcgggcctcgcgcgcctggagggccctgtggaacgaagagaggcacacagcatggcagaaaaccgagagccccgcggtgctgtggaggctgaactggatccagtggaatacacccttaggaaaaggcttcccagccgcctgccccggagacccaatgacatttatgtcaacatgaagacggactttaaggcccagctggcccgctgccagaagctgctggacggaggggcccggggtcagaacgcgtgctctgagatctacattcacggcttgggcctggccatcaaccgcgccatcaacatcgcgctgcagctgcaggcgggcagcttcgggtccttgcaggtggctgccaatacctccaccgtggagcttgttgatgagctggagccagagaccgacacacgggagccactgactcggatccgcaacaactcagccatccacatccgagtcttcagggtcacacccaagtaattgaaaagacactcctccacttatcccctccgtgatatggctcttcgcatgctgagtactggacctcggaccagagccatgtaagaaaaggcctgttccctggaagcccaaaggactctgcattgagggtgggggtaattgtctcttggtgggcccagttagtgggccttcctgagtgtgtgtatgcggtctgtaactattgccatataaataaaaaatcctgttgcactagtgtcctgcca

SEQ ID NO: 167827 - DNA, 483 bp, Homo sapiens
  Payload ID: 13014
  Gene Symbol: POP7
  Gene Name: POP7 homolog, ribonuclease P/MRP subunit
  ENST ID: ENST00000457480
  CDS Start-End: 72-483
agtttgagggcgacgcgatgaatgaatcggaacggggggtggggagacgcgggatctggagggcacacagcatggcagaaaaccgagagccccgcggtgctgtggaggctgaactggatccagtggaatacacccttaggaaaaggcttcccagccgcctgccccggagacccaatgacatttatgtcaacatgaagacggactttaaggcccagctggcccgctgccagaagctgctggacggaggggcccggggtcagaacgcgtgctctgagatctacattcacggcttgggcctggccatcaaccgcgccatcaacatcgcgctgcagctgcaggcgggcagcttcgggtccttgcaggtggctgccaatacctccaccgtggagcttgttgatgagctggagccagagaccgacacacgggagccactgactcggatccgcaacaactcagccatccacatccgagtcttcagggtca

SEQ ID NO: 167828 - DNA, 1679 bp, Homo sapiens
  Payload ID: 13015
  Gene Symbol: POPDC2
  Gene Name: popeye domain containing 2
  Uniprot ID: Q9HBU9
  ENST ID: ENST00000264231
  CDS Start-End: 168-1262
catcattccttcccaaagccaccggaagcattccttctaggaaaggtggagtcggtagtgagaagccggaggtgagaagacccctgagcggatggattcattcattttctgaatttcctatgtgaggacagtattagagcccagtgaggctttgagaggccccaaagatgagcgccaacagcagcagagtgggccagcttctcttgcagggttcagcgtgcattaggtggaagcaggatgtggaaggggctgtctaccacctagccaactgcctcttactcctgggcttcatggggggcagtggggtgtatggatgcttctatctttttggcttcctgagtgcaggttacctgtgctgcgtgctgtggggctggttcagtgcctgtggcctggacattgttctttggagcttcctgctggctgtggtctgcctgctccagctggcacacctggtataccgcctgcgtgaggacaccctccctgaggagtttgacctcctctacaagacgctgtgcctgcccttgcaggtgcccctacagacatacaaggagattgttcactgctgcgaggagcaggtcttaactctggccactgaacagacctatgctgtggagggtgagacacccatcaaccgcctgtccctgctgctctctggccgggttcgtgtgagccaggatgggcagtttctgcactacatctttccataccagttcatggactctcctgagtgggaatcactacagccttctgaggagggggtgttccaggtcactctgactgctgagacctcatgtagctacatttcctggccccggaaaagtctccatcttcttctgaccaaagagcgatacatctcctgcctcttctcggctctgctgggatatgacatctcagagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcct

SEQ ID NO: 167829 - DNA, 1958 bp, Homo sapiens
  Payload ID: 13015
  Gene Symbol: POPDC2
  Gene Name: popeye domain containing 2
  ENST ID: ENST00000341124
  CDS Start-End: 222-1328
gagagagagagagagaaagaggtttttaaattctccatgaagtgtactatgttccatcattccttcccaaagccaccggaagcattccttctaggaaaggtggagtcggtagtgagaagccggaggtgagaagacccctgagcggatggattcattcattttctgaatttcctatgtgaggacagtattagagcccagtgaggctttgagaggccccaaagatgagcgccaacagcagcagagtgggccagcttctcttgcagggttcagcgtgcattaggtggaagcaggatgtggaaggggctgtctaccacctagccaactgcctcttactcctgggcttcatggggggcagtggggtgtatggatgcttctatctttttggcttcctgagtgcaggttacctgtgctgcgtgctgtggggctggttcagtgcctgtggcctggacattgttctttggagcttcctgctggctgtggtctgcctgctccagctggcacacctggtataccgcctgcgtgaggacaccctccctgaggagtttgacctcctctacaagacgctgtgcctgcccttgcaggtgcccctacagacatacaaggagattgttcactgctgcgaggagcaggtcttaactctggccactgaacagacctatgctgtggagggtgagacacccatcaaccgcctgtccctgctgctctctggccgggttcgtgtgagccaggatgggcagtttctgcactacatctttccataccagttcatggactctcctgagtgggaatcactacagccttctgaggagggggtgttccaggtcactctgactgctgagacctcatgtagctacatttcctggccccggaaaagtctccatcttcttctgaccaaagagcgatacatctcctgcctcttctcggctctgctgggatatgacatctcagagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactgggtgaggactccaccagtctggtgctggaggattttgaggaggtgtcaggatcagaatcgtttatggattataggagtgatggggagtacatgaggtgaagggagaactaacatgggcacagccaccggctcaggatcctatagatagatgattttccctcttatttccaccagtttggcttttcagggaaggtggcagctggcagaatcccctgacaacaaaagcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctt

SEQ ID NO: 167830 - DNA, 1837 bp, Homo sapiens
  Payload ID: 13015
  Gene Symbol: POPDC2
  Gene Name: popeye domain containing 2
  ENST ID: ENST00000493094
  CDS Start-End: 461-1567
attctgcttgggaaaaacagagagcaggatgtggccgcatcatcccacgctgctggacttttcagtcctgtagtgctactttcccttgggactatttaggtttttctgctaagaaccaaatttgaagactcccaagaaacatggaaccaaggaagcttgccagagctctgcagggagagccagagccttgctgagacagcgggggtggtggggaggagagagggggggagagggggagagagagagagagagagaaagaggtttttaaattctccatgaagtgtactatgttccatcattccttcccaaagccaccggaagcattccttctaggaaaggtggagtcggtagtgagaagccggaggtgagaagacccctgagcggatggattcattcattttctgaatttcctatgtgaggacagtattagagcccagtgaggctttgagaggccccaaagatgagcgccaacagcagcagagtgggccagcttctcttgcagggttcagcgtgcattaggtggaagcaggatgtggaaggggctgtctaccacctagccaactgcctcttactcctgggcttcatggggggcagtggggtgtatggatgcttctatctttttggcttcctgagtgcaggttacctgtgctgcgtgctgtggggctggttcagtgcctgtggcctggacattgttctttggagcttcctgctggctgtggtctgcctgctccagctggcacacctggtataccgcctgcgtgaggacaccctccctgaggagtttgacctcctctacaagacgctgtgcctgcccttgcaggtgcccctacagacatacaaggagattgttcactgctgcgaggagcaggtcttaactctggccactgaacagacctatgctgtggagggtgagacacccatcaaccgcctgtccctgctgctctctggccgggttcgtgtgagccaggatgggcagtttctgcactacatctttccataccagttcatggactctcctgagtgggaatcactacagccttctgaggagggggtgttccaggtcactctgactgctgagacctcatgtagctacatttcctggccccggaaaagtctccatcttcttctgaccaaagagcgatacatctcctgcctcttctcggctctgctgggatatgacatctcagagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactgggtgaggactccaccagtctggtgctggaggattttgaggaggtgtcaggatcagaatcgtttatggattataggagtgatggggagtacatgaggtgaagggagaactaacatgggcacagccaccggctcaggatcctatcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactg

SEQ ID NO: 167831 - DNA, 1345 bp, Homo sapiens
  Payload ID: 13015
  Gene Symbol: POPDC2
  Gene Name: popeye domain containing 2
  Uniprot ID: Q9HBU9
  ENST ID: ENST00000468801
  CDS Start-End: 168-1250
catcattccttcccaaagccaccggaagcattccttctaggaaaggtggagtcggtagtgagaagccggaggtgagaagacccctgagcggatggattcattcattttctgaatttcctatgtgaggacagtattagagcccagtgaggctttgagaggccccaaagatgagcgccaacagcagcagagtgggccagcttctcttgcagggttcagcgtgcattaggtggaagcaggatgtggaaggggctgtctaccacctagccaactgcctcttactcctgggcttcatggggggcagtggggtgtatggatgcttctatctttttggcttcctgagtgcaggttacctgtgctgcgtgctgtggggctggttcagtgcctgtggcctggacattgttctttggagcttcctgctggctgtggtctgcctgctccagctggcacacctggtataccgcctgcgtgaggacaccctccctgaggagtttgacctcctctacaagacgctgtgcctgcccttgcaggtgcccctacagacatacaaggagattgttcactgctgcgaggagcaggtcttaactctggccactgaacagacctatgctgtggagggtgagacacccatcaaccgcctgtccctgctgctctctggccgggttcgtgtgagccaggatgggcagtttctgcactacatctttccataccagttcatggactctcctgagtgggaatcactacagccttctgaggagggggtgttccaggtcactctgactgctgagacctcatgtagctacatttcctggccccggaaaagtctccatcttcttctgaccaaagagcgatacatctcctgcctcttctcggctctgctgggatatgacatctcagagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggagatagatgattttccctcttatttccaccagtttggcttttcagggaaggtggcagctggcagaatcccctgacaacaaaagcttctagaattcctctccagagctactctcaagttatatccaggggacaggcccctttggctccaacccacacgcctgaactttaa

SEQ ID NO: 167832 - DNA, 247 bp, Homo sapiens
  Payload ID: 13015
  Gene Symbol: POPDC2
  Gene Name: popeye domain containing 2
  ENST ID: ENST00000495362
  CDS Start-End: 1-77
ttcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggagaactgcaacatgtttctgttttccaacagagcagtcttccctgtttctctgttctca

SEQ ID NO: 167833 - DNA, 1345 bp, Homo sapiens
  Payload ID: 13016
  Gene Symbol: POPDC3
  Gene Name: popeye domain containing 3
  Uniprot ID: Q9HBV1
  ENST ID: ENST00000254765
  CDS Start-End: 280-1155
aagctccgggcagggctgggaaggaaaggaaataccaaaatatttgcagactggatccaaatcaggagcccagatgaacttaaagaagcgagcatgggattcttagtttttcaagatccgtacacacgaagcctttaatcagcatcaactccagtgtccgttttctctggttttgtgaagactgcacaaaactctcatgatggagaaccaaaggacttagttacctgtttcagtgtcatctaaagtcaactgaaaagtgaagcaggcagtaatacagccatggaaagaaattcaagtttatggaagaacctaatagatgaacacccagtctgcacaacctggaagcaagaggccgaaggagccatttatcatcttgccagtattttatttgtagtaggtttcatgggtggcagtggattcttcgggctcctttatgtcttcagtttgctggggttgggttttctctgttctgctgtctgggcttgggtagatgtctgtgcagctgacatattttcctggaattttgtactgtttgtcatctgcttcatgcaatttgttcatattgcatatcaagttcgcagcataacctttgcccgagaattccaagtgttgtacagctcccttttccagcccctggggatctctttgcctgtcttcagaacgattgctttgagctctgaagtggttactttggaaaaggaacactgttatgccatgcaggggaaaacttccattgataaactctccttgcttgtttcaggaaggatcagagtgacagttgatggcgaatttctgcattacattttcccccttcagttcctggattctcctgagtgggattcactgagacccacagaggaaggcatttttcaggtaaccctcactgcagaaactgattgtcgatatgtgtcttggaggagaaagaaattatatctgctctttgctcagcatcgctacatctcccgccttttttcagtgctaattggcagtgacattgcagataaactctatgccttgaatgacagggtatatataggaaaaagatatcactatgatattcggctacccaacttctatcaaatgtcaactccagaaatacgcagatcacccctgacacaacattttcagaattccagacgatactgtgataaatgacatcaaagtctgaaatttataagtataaaaaaagactctctcttcatcattccccagtgaaatagcaaaatacaaaaaaagagctccctaatgtttttataaatcaaattcagaagcgagatgccattgccaactgttttattcctttcaacaactgcattgtgaataaactttacaaatttttcttgta

SEQ ID NO: 167834 - DNA, 582 bp, Homo sapiens
  Payload ID: 13016
  Gene Symbol: POPDC3
  Gene Name: popeye domain containing 3
  ENST ID: ENST00000429112
  CDS Start-End: 280-582
gttttattgaagtataatatgcacacataaatggacatatataaatgtacaacttgatgaattttctgatgaatttcactcaatattccagaatcctgactgtataaggaacatgataacatgaatcttacaggacattatgtcacttattataatgtatgaatttaatattttgcctttcaaaatcataaagggcaagagtcatcagggatctgaaatacacttcctctaccccccacccctccccaattatgtgctctctttctccttcccttataaatgttgttcttgtgttttgataggatcagagtgacagttgatggcgaatttctgcattacattttcccccttcagttcctggattctcctgagtgggattcactgagacccacagaggaaggcatttttcaggtaaccctcactgcagaaactgattgtcgatatgtgtcttggaggagaaagaaattatatctgctctttgctcagcatcgctacatctcccgccttttttcagtgctaattggcagtgacattgcagataaactctatgccttgaatgacagggtatatataggaaaaaga

SEQ ID NO: 167835 - DNA, 1755 bp, Homo sapiens
  Payload ID: 13017
  Gene Symbol: PORCN
  Gene Name: porcupine homolog (Drosophila)
  Uniprot ID: Q9H237
  ENST ID: ENST00000326194
  CDS Start-End: 44-1429
tgacagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaacaagaaacgcaaagccaggggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaat

SEQ ID NO: 167836 - DNA, 1556 bp, Homo sapiens
  Payload ID: 13017
  Gene Symbol: PORCN
  Gene Name: porcupine homolog (Drosophila)
  ENST ID: ENST00000355092
  CDS Start-End: 1-1218
gggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaagtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggct

SEQ ID NO: 167837 - DNA, 1848 bp, Homo sapiens
  Payload ID: 13017
  Gene Symbol: PORCN
  Gene Name: porcupine homolog (Drosophila)
  Uniprot ID: Q9H237
  ENST ID: ENST00000355961
  CDS Start-End: 140-1510
gctggtcccggccttgcggcctgcgggggaggctgcccggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaacaagaaacgcaaagccaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggct

SEQ ID NO: 167838 - DNA, 1877 bp, Homo sapiens
  Payload ID: 13017
  Gene Symbol: PORCN
  Gene Name: porcupine homolog (Drosophila)
  Uniprot ID: Q9H237
  ENST ID: ENST00000359882
  CDS Start-End: 180-1547
atttaaagggcccgctcgccgcgccgctctgggagccgctgctggtcccggccttgcggcctgcgggggaggctgcccggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaagggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattc

SEQ ID NO: 167839 - DNA, 1672 bp, Homo sapiens
  Payload ID: 13017
  Gene Symbol: PORCN
  Gene Name: porcupine homolog (Drosophila)
  Uniprot ID: Q9H237
  ENST ID: ENST00000361988
  CDS Start-End: 102-1454
ggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaagtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctgggg

SEQ ID NO: 167840 - DNA, 1368 bp, Homo sapiens
  Payload ID: 13017
  Gene Symbol: PORCN
  Gene Name: porcupine homolog (Drosophila)
  Uniprot ID: Q9H237
  ENST ID: ENST00000367574
  CDS Start-End: 1-1368
atggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaagggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctga

SEQ ID NO: 167841 - DNA, 619 bp, Homo sapiens
  Payload ID: 13017
  Gene Symbol: PORCN
  Gene Name: porcupine homolog (Drosophila)
  ENST ID: ENST00000470275
  CDS Start-End: 146-406
tctacatgggctgggcagccccaaactgaaatgtgagtgccagagtgcatcctttaagcgaggtctgccccacggacacccgctccctctgtgtccctgctttgacagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaagg

SEQ ID NO: 167842 - DNA, 558 bp, Homo sapiens
  Payload ID: 13017
  Gene Symbol: PORCN
  Gene Name: porcupine homolog (Drosophila)
  ENST ID: ENST00000489940
  CDS Start-End: 266-558
gaggctgcccggaggaggcagcggcggcggcagcgcgtcctcggtccccaggaccacggcttctttcctgccagagcgactctaccttggaaaccagggattccccttcccgtcgcccgccccatttgatatatgggcctgaaatgtatgccatcccatcaccatcggactggactgttcacagcactggagagacagaggtccttcattcactccaggtcacaggctatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtctt

SEQ ID NO: 167843 - DNA, 1328 bp, Homo sapiens
  Payload ID: 13017
  Gene Symbol: PORCN
  Gene Name: porcupine homolog (Drosophila)
  ENST ID: ENST00000472520
  CDS Start-End: 150-302
gggagccgctgctggtcccggccttgcggcctgcgggggaggctgcccggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgtgagatgcacatggtagacaccgtgacatggcacaagatgcgaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaa

SEQ ID NO: 167844 - DNA, 1975 bp, Homo sapiens
  Payload ID: 13017
  Gene Symbol: PORCN
  Gene Name: porcupine homolog (Drosophila)
  ENST ID: ENST00000485288
  CDS Start-End: 172-624
gagccgctgctggtcccggccttgcggcctgcgggggaggctgcccggaggaggcagcggcggcggcagcgcgtcctcggtccccaggaccacggcttctttcctgccaggtcacaggctgtgcgtgtgcatgccgaacacccacatgcacacagttggtggctcagtctgatgtacctgacttctcacgccttcccccagtcctccagtaccgtgcctctacatgggctgggcagccccaaactgaaatgtgagtgccagagtgcatcctttaagcgaggtctgccccacggacacccgctccctctgtgtccctgctttgacagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaagtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattc

SEQ ID NO: 167845 - DNA, 745 bp, Homo sapiens
  Payload ID: 13017
  Gene Symbol: PORCN
  Gene Name: porcupine homolog (Drosophila)
  ENST ID: ENST00000528612
  CDS Start-End: 131-391
ggccttgcggcctgcgggggaggctgcccggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaa

SEQ ID NO: 167846 - DNA, 1371 bp, Homo sapiens
  Payload ID: 13017
  Gene Symbol: PORCN
  Gene Name: porcupine homolog (Drosophila)
  Uniprot ID: Q9H237
  ENST ID: ENST00000537758
  CDS Start-End: 1-1371
atggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaacaagaaacgcaaagccaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctga

SEQ ID NO: 167847 - DNA, 1282 bp, Homo sapiens; identical to SEQ ID NO: 141697
  Payload ID: 13018
  Gene Symbol: HMBS
  Gene Name: Porphobilinogen deaminase
  ENST ID: ENST00000630018
  CDS Start-End: 154-399

SEQ ID NO: 167848 - DNA, 507 bp, Homo sapiens; identical to SEQ ID NO: 141690
  Payload ID: 13018
  Gene Symbol: HMBS
  Gene Name: Porphobilinogen deaminase
  ENST ID: ENST00000629519
  CDS Start-End: 150-507

SEQ ID NO: 167849 - DNA, 755 bp, Homo sapiens; identical to SEQ ID NO: 141693
  Payload ID: 13018
  Gene Symbol: HMBS
  Gene Name: Porphobilinogen deaminase
  ENST ID: ENST00000630812
  CDS Start-End: 195-755

SEQ ID NO: 167850 - DNA, 1155 bp, Homo sapiens; identical to SEQ ID NO: 141692
  Payload ID: 13018
  Gene Symbol: HMBS
  Gene Name: Porphobilinogen deaminase
  ENST ID: ENST00000626431
  CDS Start-End: 595-1155

SEQ ID NO: 167851 - DNA, 1501 bp, Homo sapiens; identical to SEQ ID NO: 141686
  Payload ID: 13018
  Gene Symbol: HMBS
  Gene Name: Porphobilinogen deaminase
  ENST ID: ENST00000627066
  CDS Start-End: 152-1237

SEQ ID NO: 167852 - DNA, 1559 bp, Homo sapiens; identical to SEQ ID NO: 141695
  Payload ID: 13018
  Gene Symbol: HMBS
  Gene Name: Porphobilinogen deaminase
  ENST ID: ENST00000628117
  CDS Start-End: 292-1326

SEQ ID NO: 167853 - DNA, 936 bp, Homo sapiens; identical to SEQ ID NO: 141696
  Payload ID: 13018
  Gene Symbol: HMBS
  Gene Name: Porphobilinogen deaminase
  ENST ID: ENST00000627143
  CDS Start-End: 128-373

SEQ ID NO: 167854 - DNA, 1469 bp, Homo sapiens; identical to SEQ ID NO: 141694
  Payload ID: 13018
  Gene Symbol: HMBS
  Gene Name: Porphobilinogen deaminase
  ENST ID: ENST00000630574
  CDS Start-End: 292-1206

SEQ ID NO: 167855 - DNA, 708 bp, Homo sapiens; identical to SEQ ID NO: 141699
  Payload ID: 13018
  Gene Symbol: HMBS
  Gene Name: Porphobilinogen deaminase
  ENST ID: ENST00000631122
  CDS Start-End: 135-708

SEQ ID NO: 167856 - DNA, 1351 bp, Homo sapiens; identical to SEQ ID NO: 141689
  Payload ID: 13018
  Gene Symbol: HMBS
  Gene Name: Porphobilinogen deaminase
  ENST ID: ENST00000629150
  CDS Start-End: 121-1086

SEQ ID NO: 167857 - DNA, 832 bp, Homo sapiens; identical to SEQ ID NO: 141691
  Payload ID: 13018
  Gene Symbol: HMBS
  Gene Name: Porphobilinogen deaminase
  ENST ID: ENST00000628160
  CDS Start-End: 120-311

SEQ ID NO: 167858 - DNA, 1548 bp, Homo sapiens; identical to SEQ ID NO: 141688
  Payload ID: 13018
  Gene Symbol: HMBS
  Gene Name: Porphobilinogen deaminase
  ENST ID: ENST00000630689
  CDS Start-End: 264-1298

SEQ ID NO: 167859 - DNA, 1347 bp, Homo sapiens; identical to SEQ ID NO: 141698
  Payload ID: 13018
  Gene Symbol: HMBS
  Gene Name: Porphobilinogen deaminase
  ENST ID: ENST00000625884
  CDS Start-End: 105-1097

SEQ ID NO: 167860 - DNA, 1411 bp, Homo sapiens; identical to SEQ ID NO: 141687
  Payload ID: 13018
  Gene Symbol: HMBS
  Gene Name: Porphobilinogen deaminase
  ENST ID: ENST00000627967
  CDS Start-End: 111-1145

SEQ ID NO: 167861 - DNA, 11114 bp, Homo sapiens
  Payload ID: 13019
  Gene Symbol: PGAP1
  Gene Name: post-GPI attachment to proteins 1
  Uniprot ID: Q75T13
  ENST ID: ENST00000354764
  CDS Start-End: 116-2884
cggctccgggggtggcggtcggacagtgtctagcacgctcagtccgggcttggggccccgcggcggagaaggaggtagagggggcggcggcggcggcggcggtggtggcggcaccatgtttcttcactcagttaatctctggaacctggcgttttatgtcttcatggtctttctggcaaccctggggctgtgggatgtcttcttcggcttcgaggagaataagtgcagtatgagctacatgtttgagtacccggagtatcagaaaatagaacttccaaagaaactggcaaaacgctatcccgcatatgagttgtatctttatggagagggatcctatgctgaagaacacaaaattctccctttgacgggtattccagttctctttcttcctggtaatgctggaagttataagcaagttcgttctattggctccattgcacttagaaaagcagaggacattgacttcaagtaccactttgacttctttagtgtgaacttcaatgaagaactggtggctttgtatggtggaagtcttcagaagcagaccaagtttgtacatgaatgtattaaaacaattctcaaactctataagggtcaagaatttgctccaaaaagtgtggcaataattggtcattctatgggtggccttgttgcaagagcattgcttacactgaaaaattttaagcatgatctgataaatcttcttattacacaagccacacctcatgttgctcctgtgatgccattagatcgtttcattacagatttttatacgactgtaaacaactattggattctaaatgctcgacacataaatttaaccacactttctgtagctggaggattccgggattaccaagttcgttcaggattgacttttctaccaaaattaagccatcataccagtgccttatctgttgtgagttcagcagtgcctaagacctgggtctcaacagaccacctctccattgtgtggtgtaaacaattgcagttgactacagttcgagcattctttgatcttattgatgctgatactaaacaaataactcaaaattccaagaagaaactgtcagttttgtatcaccactttataagacacccatcaaaacattttgaggaaaatccagctataatttctgacttaacagggacatctatgtgggttctagtaaaagtgtccaaatggacctatgtagcttacaacgaatctgagaagatatattttacatttcctcttgaaaatcatagaaaaatctacactcatgtctattgtcagagcactatgctggatacaaatagttggatttttgcttgcataaacagcacttctatgtgcctgcaaggggttgatttatcatggaaagctgaactgctgccaacaattaagtatctgacattaagacttcaagactatccatctttgtctcatcttgttgtttatgtaccatctgttcgtggaagtaagtttgttgtagattgtgaattctttaaaaaagagaaaagatacatacagcttcctgtaactcatcttttttcctttggattgtcttcaaggaaagtggtgttaaatacaaatggcctatactacaatctagagcttctgaactttggacagatataccaagcttttaaaatcaacgtggtaagcaagtgctcagcagtcaaagaagaaataaccagtatctatagacttcatattccttggtcttatgaagattcactaaccattgcacaggctccatcttccacagaaatttctctgaaactccatattgctcaaccagaaaacaatacccatgtggcattatttaaaatgtacacgtcatcagactgtcggtacgaggtgacagttaagacttccttttcacaaatacttggacaggtagttagatttcatggtggagctcttcctgcttatgtcgtatctaatatccttcttgcttatagaggacagttatattctcttttctcaacaggttgttgcttagaatatgctaccatgttggataaagaagccaaaccatacaaagttgatccttttgtaattatcattaagtttctgttggggtataaatggtttaaagaattgtgggatgtattattgttaccagaattagatgccgtcattttaacttgtcagagtatgtgtttccccctgatatccttgattctctttctgtttggaacgtgtactgcctactggagtggcctactgtcttctgcatctgtgagacttctttcttcattgtggctagctttgaaaagaccctctgaacttcctaaagatatcaagatgatatcaccagacttgccctttttgacaattgtcttgatcatagttagttggacaacttgtggagcactagccatacttctttcttatctttactatgtgtttaaggttgttcatctgcaagccagcttaacaacttttaagaatagccagcctgtgaatcccaaacactctagaagaagtgaaaagaaatccaatcatcataaagactcctcaatacaccatcttcgtttatctgccaacgatgctgaagatagccttcgcatgcacagtactgtgattaacttactaacatggattgtattactcagcatgccttctctaatttattggctaaagaatcttaggtattattttaaacttaatcctgatccatgtaaacctttggcatttatccttattccgactatggcaattcttggaaatacttacactgtttcaataaaatcaagtaaattgttgaagactacttcacaatttccacttcctctggctgttggtgtgattgcttttgggtcagcacatttatataggcttccatgctttgtcttcattcctcttttactccatgcattatgcaactttatgtaagattggacttaaggaatgatgaagataatttatgtgtttagggccagtgataagagggaacacacagatccatcagtatggacagcaagatcctttggagaagacaagtctatttttacaatattgaaaataggaaattagttttgtaatgtttgagggaagtagttgaagcatggttttgttttgtggtgtggaatccatgtagtaatcatttttgaaaaattcatgaagggatatatggtgatcactatcattgaggactcctgtgcatataaaatagtctgttttatcaactgtacgagaagtctgatatgagagatttagtagatgcagcattatttgcagtctcactgcaagcattctgctcatttcatcaaactttttttcacaaaagtaggttattttgaatttgctatagtttacctattaagaaataagtctttaaataactgatgaaatttatagctgtttggtttctcaaaggttaaatagccacagaaagcctttggttagtttttggcagccaccatgaacaaagtggatcttgtcttcttacatctatgaaaatagagctttgaatggtaaggagatatgttttcttggtaaccaatgcaagattgatgggtggaaacatgattcaaacttacacaatttttcttgctatttttcaaatatgaatcttactatatattctcggtgaacatcaggagactattaaagaggtctgctgttaaatgtaaagaaaaaatgctcgtagctatttgcttcctggtattggagcagttcagttgtttagtttataccattggattcaattcattgcaccatggttgccaaaagtgcctgaggtcataatggattgttaaaataactaaattccagtggttggaaactctaggtttgtaccattttttctgctgtgggaaaaaacaacaacaacaacatgatcaaggtaacatcacatttgatgtataatattatactattaatggaatatcagtagacaactgttaacccattagtagcatgagtataaacagtacacctgaataaattggagacattagccactaggtttaacagtggaatcttgatttgcctaggtgacttctgggattactgtttgacaaataagagtaacattttatttcatttcagaatttacgtcacttttagctacaagagtaggaagaaggtaatcggcaaggcagaagagtatactctttgccttaggatagcgtaaactcaggctgagacatacccggcttatagagttcttctagatgtgtagactgtaaatgcccaaatcctctcaactaaagttttagtgattccacaaagcctctcatgtaaatttccagtgattccaccattgcacttgtgaatatgtatccttgttagtacccagggatgtcctcgagcaccagttttattttatctgccattgcatctggattccattacagcctctcagctgttactgcctgtggacagttacttctgcttactgcctgtagagagttacctaacttctcttctcagttcttcctcaggtcctggctattttggcctcagttgaagggagtcttgctctcatctctgagggttttaagtttgtttgatcccattgttgtcttttctagctttgagcatgtttttcagtattcatattttaacttactgagaacattaaagggaaatgataaactcgtggtggggatatggcagacaggtgcttgtttgtttgagagaagtagcagaagagataaaatacaaagtgctatatgtttcagctggagaggaaagagagagaatttattagattatatacttgtcccatggcataccacgtatatgtttaaatagggacacatctccctatgtttaactatacttataaacaactttgatacacattgcgtcttttattctgtcacctgatattttagtgtatctcaagttacagattacatgtgtccttaaactatttctgaatttggacttagttccatatacagaaagaactttagaaaattcattaatttggatcttctattgatagccataaatattatgtttatgtattctaaaacctctttgtttagttagtactgttcatgaatgtaacaagcttcaatttctcatttgtgagtagtacatttgctttttgtttgtttgtttgtttgtttttgagatggagtctcacgctgtcaccaggctggagtgcagtggcgcgatttcagctcactgcaacctccacctcccaggtgcaagtgatgcccctgcctcagcctcccgagtagctgggactacagacacccgccaccacacctggctaatttttgtatttttagtagagacggggtttcaccatgttggctaggctggtctcaaactcttgacctcgtgatttgcccgcctctgcctccccaaagtgctgggattacaggcgtgagccaccacgcccagccgtacatttactttttaaagcagcagactaggtacactaattctcactcaaatattttcatgggaatgtagttatcaccaagtcctaaagtattatttatgccaaaaaaaatttcattttaaggactacaaaaatgattctaattaaacattttataatcaatagtaggttgggtctttagccattatatgtgtatatatacagacacatatgtatacacttacattttgacagggtcttcattgagtcttgatgcactttaaacccagctggctaccagagatgcgaaggtgggctctttgaagattagcaaaatggacgtttctgtcacttgagaaaaggaaagttctttgcctttaaattacacagttttcatcatgcccacaatctatattattggctggttaaacagcactgccctattagcaatgttaacaaaaatgaaattatttattggcggttatagattatctaattcaggaaatttctgagctcaacttttacagcaactgttatgccttctaatttagcaattgagttatgagtaagttttgtgcttaactcctagaccctattgttgataaccagatcaaatatagtctgtacagaggaaaacactgggaacatttagtatttctaaagcctcctttggagttactactgattgtaatttggaactgataataggtagagattgctaacactgttttttttcctggatcttttttatgccagaaattaaacaggttctgctaactcttttttttctcttggttatcaccagaatgaaaatatttaaagtgatgactctagaaaagccatctgtgcctggttaacattgagtttgagtctcttcaatatatattgatcatgtattgattaatctttattttttcatattttggctagacaaattcagatctatataatggaataccccttcttgagtgaactatactactaatctacatgattatatagtaaggaaaaaagaagaaataactgtaataggcatagtgtttgttgttggttgtcttgtcattcatgtgatactactcatttccaaaattcacacaaacttacatgaggtggattatttgttttgttcattatttagttcctatatgttttttctttagaaacagagtctcattctgtcacccaggctggagtccaatggggcggtcatagttcactgcagccttgaactctttggctcatgtgatcctcccatctcagcctcccacagcaggtgagactacaggtacatgccactgtgcctgactttttaatttttttgtagagacgaggtttcagtttgttgcccaagctgatcttgaactcctggtttcaagcgatcctcccacctcggcctcccaaagtagtgggatttcaggcatgaccacctggcctagttcctatacttttcttaattcttcagacttctcacatttagtatagtgcattcatttcatcttgctgtttattagcaccctttgtggccaagggaaataaaaggtggtaaaattcagttttcagtttagttcttgaaagctctgggaaatggaggaaacacaaaactatgaattaaactagggctgttgatttctgaacccccagataaatcagttgacccacattttcattttaggtgttaggtccaaattagcataatgtcttgcattattattaggttcagtgtgaaactttacagtgctgcatttgaagtttagtaactggttattattaatcatttgggaaaaatgaaaatgtgttgggactttctatgactaggcatttgttgattatttttcatgattgctttttgttttctcattgtgtaggatttgtgaacttgtatattacaggaaacaagatactttgtaaaatttactggggaaaatccatttggagtgcatgacatttgccaggataagaaagcagtaatatgtttgtattataaaattacaccctgccagaaaactttctttcctagtaaggtaaatgtagaagggacttttacagcatagtaagttgattaggagccaaaattttattccagtttttttttgaactaagaatgttttaaattctgtaatgaacttttatgtttacccattactcatgcattctttcacaatatgtttaatagcctgaggaaataggaaagctgtgaagctactaccattctttacttttaataagaataataggaaagaaaagtcaggtcagtaatccaaatccaaatatgtatactgcaaatgctcaagaagtcacattttttgataaattgtattgagtacagaagaacttatatgaatttattatctgttaataacttagttttgacaacagaataacatttggaaattgtgagaataatcaagctgtttttccattaacagtgtaaattcataacatgtccttcaaaaggtgatattctaagctgtcttaattgtctacggttgataacttttaaataaagtacaggactttctgaaagtgtttggcatgttatgctgccaaaaacaatctgtgttttgaaataccaattaatcagttaatttctgaagactttgtataggacttgatatatgagtcagaatctgtctgtactcattctgtacattgtaactttgaacacttatgaaaaactgtatctgttggtgtgttttgattagttagtgtagatttgtttgcgtatttgaattccgattttagtttaggaagactaaaagtagccatttttgtaaagttcatatgctattttttaatgtcatttttgtttttaatatttatacaatagtgatgttactagtaaaaaatgtttatagataacacgtagagctattaactgttcaaaagcctacatgataggcatattttgtatttcgtgttgcactcgttctgtttcatattggactttttacatcccttttttagcaaaaaaaagagacacatttgaattctctttagcataaagctgtgcattggaaactatgtgactgtatccatacggttagcaaaatactctttgccaccaaaggtaaatgaaactgtaaaatacctctggatatttgtgccaatgaacttttcttagcatattaggattaaagcaaaaataatcttttcagtatgtttcatctaggacttacaataaatgtttaaaccatgaaaacttatatttcataccctaatttttctttgaaaatattcaagatttgtagcctagtgtgttctattttgtgtgattgcttgaatgttttctgattttattgggtaaaagtttgcctagtaatgatctttcagcaattcattgaaataattatttgaagtaatcttgcttcagatttaatttgtgatgtacattgttgtacaagccattttagtacaggtgtctcatttatgtagttgaaaggtgactgtggaatttcttttgttttttatgtatttccattcagtctctttatatagtcacatgtttcacaggggaacttgtccactggaacctaacatagtacaaccttttaatatgcgtatcttaaaggaaaatattataaaacaagatattaatactaaagtgttaacattaatatgttgttctcatggaagaaaagtagaaaatgtgataggcttagaaattattttttatcagcattaagtgcttcaatttctccccataaagattctaaggaaatttcagttcctcatattatagttttccccataatttaatattactaagtatttctctgcccagtaatgttgatgcagtttgcataaatagccttggaagtaaggaggcaggacagaaagccaaatatcgaaatctctggccttgatttagtgacagtttattctaatggggaccataggtgttattagtaaaaagatagtgtacaaggcctaagttcagtttacattgttctttgaaatgagttcatcttttgtgttgaataattgtattctaagtaggagatgcctgtatttaacataatcatgctttctatataatcaaatatgtatttgttggaatactggtagaaataaccttcccttcctccactgtgcagtggaaaaaaaactcccgatttatactgtatataaattaggaaattatgttacatatttacatttttaaaaatataaaaatgacatattattttgaagtgattgtattatagtttctgaagcttatgactggctataaatataacaacatacccatgagaaaccagaccaaaattgaatatatatcatcactgtgaccttgaacttatagtcatttgggataaaacagagtgtgccttgaaatgataaagagtgccctgcaattttataactgtacattttattatgggtggtcctctcaaattggccccaaatccttgtcttcgaggttggtgaaataaaagtttaaaataaaagttgactggtatttcctttagtatttccagaactattgctgtagaggcctcccttaattttcagagttctcattttgaattaaagtagacttacgctacatagatgtagaaaattaggtttggcttaggtttctgaaaaaatattctaggagaaggtggtagcattgttctgaacttaccacacttggaaaaactaatcttcaaatgtaattttttgtcttattaatgagtaatctgtcaaagacatgaattctttgacttgtgctcattctttctgaacttattgaggcttatatatatcaaataaggttaatttacacaataattatttttaataattaataaactcattcatgtagtatattttaaaacattatttcctctcatttttccttctcttttttcttcctatatatttttaaggcttcaagagaaaacgggcttcagtttttaaaaaaatgtagacttgcatttttactgtgcttatttaaaataatggatataatttatattaaggtccaaattattttattcacaggataatcatggtctctgataaaagatgcccacatttctgtgtactcacagttgttgtatatttttcaatttcaattttgaaagtaaactcaacacattgttttcccattttacctccactacctactcgccagacaaaaatatagatttctctaaaaacacatacaaagaaaatgtctttccttaaaacatgatcttattgacatgaaggtagtttgagcaagggtatgtaataaaataaatggctctcaacctgcatcaatttttatactatagttaaaaaatttatagaggacaacctatgtgttatgctgagatagactcagtaatcatttgtttgcaaattgattatttttttctcatccatccagaaagtacagtgcataacaacaacacttaacaagtgcagaggaacctgtcctgtagtatataataaaaaatgattgtcaccttgctgatctttccatttaaacatgcatgatctccagtactttgtacaatgtatagtatattaaatacatttatgtgtaattttgtgtgtatttttatatggtataattaaaattattacatttatgtgattgtaattcacaaaaagtactacttactatattctgtagagtgtgttgtgaatgtttttacctgtgtttgagcattatggtgtaggtttaatagatgaatatttgccttcagtctctgctcaggtattaatgtgtagtaatttttggtgctttctttttaatctgtgataatctggtgttctgaatgttcaaaaataaatttggttgaatacgca

SEQ ID NO: 167862 - DNA, 677 bp, Homo sapiens
  Payload ID: 13019
  Gene Symbol: PGAP1
  Gene Name: post-GPI attachment to proteins 1
  ENST ID: ENST00000374738
  CDS Start-End: 130-677
gcgcggctggggctcggctccgggggtggcggtcggacagtgtctagcacgctcagtccgggcttggggccccgcggcggagaaggaggtagagggggcggcggcggcggcggcggtggtggcggcaccatgtttcttcactcagttaatctctggaacctggcgttttatgtcttcatggtctttctggcaaccctggggctgtgggatgtcttcttcggcttcgaggagaataagtgcagtatgagctacatgtttgagtacccggagtatcagagttcagcagtgcctaagacctgggtctcaacagaccacctctccattgtgtggtgtaaacaattgcagttgactacagttcgagcattctttgatcttattgatgctgatactaaacaaataactcaaaattccaagaagaaactgtcagttttgtatcaccactttataagacacccatcaaaacattttgaggaaaatccagctataatttctgacttaacagggacatctatgtgggttctagtaaaagtgtccaaatggacctatgtagcttacaacgaatctgagaagatatattttacatttcctcttgaaaatcatagaaaaatctacactcatgtctattgtcagagcactatgctggatacaaatagttggatttttgcttgcataaacag

SEQ ID NO: 167863 - DNA, 1246 bp, Homo sapiens
  Payload ID: 13019
  Gene Symbol: PGAP1
  Gene Name: post-GPI attachment to proteins 1
  ENST ID: ENST00000409188
  CDS Start-End: 186-1100
tttttcctaacattctagtgttttgaagctgctacaagtgattgatttcgagctttttttaaaaactcctcctttgtacaaaacagaaccgaaattcttcaaaacgaattaagtcatttgcgagtttgaatggaagctggacgaaattgcctcctccagttaacgtggaacccattccccaagagatggaggttctggagagcaagaaaatagaacttccaaagaaactggcaaaacgctatcccgcatatgagttgtatctttatggagagggatcctatgctgaagaacacaaaattctccctttgacgggtattccagttctctttcttcctggtaatgctggaagttataagcaagttcgttctattggctccattgcacttagaaaagcagaggacattgacttcaagtaccactttgacttctttagtgtgaacttcaatgaagaactggtggctttgtatggtggaagtcttcagaagcagaccaagtttgtacatgaatgtattaaaacaattctcaaactctataagggtcaagaatttgctccaaaaagtgtggcaataattggtcattctatgggtggccttgttgcaagagcattgcttacactgaaaaattttaagcatgatctgataaatcttcttattacacaagccacacctcatgttgctcctgtgatgccattagatcgtttcattacagatttttatacgactgtaaacaactattggattctaaatgctcgacacataaatttaaccacactttctgtagctggaggattccgggattaccaagttcgttcaggattgacttttctaccaaaattaagccatcataccagtgccttatctgttgtgagttcagcagtgcctaagacctgggtctcaacagaccacctctccattgtgtggtgtaaacaattgcagttgactacagttcgagcattctttgatcttattgatgctgatactaaacaaataactcaaaattccaagaagaaactgtcagttttgtatcaccactttataagacacccatcaaaacattttgaggaaaatccagctataatttctgacttaacaggaatctgagaagatatattttacatttcctcttgaaaatcatagaaaaatctacactcatgtctattgtcagagcactatgctggatacaaatagttggatttttgcttgcataaacagcacttctatgtgcctgcaaggggttgatttatcat

SEQ ID NO: 167864 - DNA, 2443 bp, Homo sapiens
  Payload ID: 13019
  Gene Symbol: PGAP1
  Gene Name: post-GPI attachment to proteins 1
  Uniprot ID: Q75T13
  ENST ID: ENST00000409475
  CDS Start-End: 115-1893
ggctccgggggtggcggtcggacagtgtctagcacgctcagtccgggcttggggccccgcggcggagaaggaggtagagggggcggcggcggcggcggcggtggtggcggcaccatgtttcttcactcagttaatctctggaacctggcgttttatgtcttcatggtctttctggcaaccctggggctgtgggatgtcttcttcggcttcgaggagaataagtgcagtatgagctacatgtttgagtacccggagtatcagaaaatagaacttccaaagaaactggcaaaacgctatcccgcatatgagttgtatctttatggagagggatcctatgctgaagaacacaaaattctccctttgacgggtattccagttctctttcttcctggtaatgctggaagttataagcaagttcgttctattggctccattgcacttagaaaagcagaggacattgacttcaagtaccactttgacttctttagtgtgaacttcaatgaagaactggtggctttgtatggtggaagtcttcagaagcagaccaagtttgtacatgaatgtattaaaacaattctcaaactctataagggtcaagaatttgctccaaaaagtgtggcaataattggtcattctatgggtggccttgttgcaagagcattgcttacactgaaaaattttaagcatgatctgataaatcttcttattacacaagccacacctcatgttgctcctgtgatgccattagatcgtttcattacagatttttatacgactgtaaacaactattggattctaaatgctcgacacataaatttaaccacactttctgtagctggaggattccgggattaccaagttcgttcaggattgacttttctaccaaaattaagccatcataccagtgccttatctgttgtgagttcagcagtgcctaagacctgggtctcaacagaccacctctccattgtgtggtgtaaacaattgcagttgactacagttcgagcattctttgatcttattgatgctgatactaaacaaataactcaaaattccaagaagaaactgtcagttttgtatcaccactttataagacacccatcaaaacattttgaggaaaatccagctataatttctgacttaacagggacatctatgtgggttctagtaaaagtgtccaaatggacctatgtagcttacaacgaatctgagaagatatattttacatttcctcttgaaaatcatagaaaaatctacactcatgtctattgtcagagcactatgctggatacaaatagttggatttttgcttgcataaacagcacttctatgtgcctgcaaggggttgatttatcatggaaagctgaactgctgccaacaattaagtatctgacattaagacttcaagactatccatctttgtctcatcttgttgtttatgtaccatctgttcgtggaagtaagtttgttgtagattgtgaattctttaaaaaagagaaaagatacatacagcttcctgtaactcatcttttttcctttggattgtcttcaaggaaagtggtgttaaatacaaatggcctatactacaatctagagcttctgaactttggacagatataccaagcttttaaaatcaacgtggtaagcaagtgctcagcagtcaaagaagaaataaccagtatctatagacttcatattccttggtcttatgaagattcactaaccattgcacaggctccatcttccacagaaatttctctgaaactccatattgctcaaccagaaaacaatacccatgtggcattatttaaaatgtacacgtcatcagactgtcggtacgaggtgacagttaagacttccttttcacaaatacttggacaggttgttgcttagaatatgctaccatgttggataaagaagccaaaccatacaaagttgatccttttgtaattatcattaagtttctgttggggtaagttttattatctgtgataatgattttaattgtgttttacatgtaacattatatttggttccataatgcaatataaattttcatacagatttggcagttgacttgtttcattaaatgaggttttttttttctcttaggcaaaggtctaataagtatatcaatgtctacttcaatagtatcatttcaaaagtaattattcactttatgtatatcagtctaaacttagactgcctttaatgtttgtaaataggtgtatatggtccatgatctgtgagtatcctagattcaaacgcaaatcattacagggtattgatgaaacagtgcctctctgatcacttttaaaagtatattttagacctctctaccctagttaacattccattcttaatttagtcacattttcagatttttggttaagcatcaatatgtagatctttttttccatcattacaactaacttggctttct

SEQ ID NO: 167865 - DNA, 6124 bp, Homo sapiens
  Payload ID: 13019
  Gene Symbol: PGAP1
  Gene Name: post-GPI attachment to proteins 1
  ENST ID: ENST00000422444
  CDS Start-End: 1-480
tcaccagacttgccctttttgacaattgtcttgatcatagttagttggacaacttgtggagcactagccatacttctttcttatctttactatgtgtttaaggttgttcatctgcaagccagcttaacaacttttaagaatagccagcctgtgaatcccaaacactctagaagaagtgaaaagaaatccaatcatcataaagactcctcaatacaccatcttcgtttatctgccaacgatgctgaagatagccttcgcatgcacagtactgtgattaacttactaacatggattgtattactcagcatgccttctctaatttattggctaaagaatcttagtaaattgttgaagactacttcacaatttccacttcctctggctgttggtgtgattgcttttgggtcagcacatttatataggcttccatgctttgtcttcattcctcttttactccatgcattatgcaactttatgtaagattggacttaaggaatgatgaagataatttatgtgtttagggccagtgataagagggaacacacagatccatcagtatggacagcaagatcctttggagaagacaagtctatttttacaatattgaaaataggaaattagttttgtaatgtttgagggaagtagttgaagcatggttttgttttgtggtgtggaatccatgtagtaatcatttttgaaaaattcatgaagggatatatggtgatcactatcattgaggactcctgtgcatataaaatagtctgttttatcaactgtacgagaagtctgatatgagagatttagtagatgcagcattatttgcagtctcactgcaagcattctgctcatttcatcaaactttttttcacaaaagtaggttattttgaatttgctatagtttacctattaagaaataagtctttaaataactgatgaaatttatagctgtttggtttctcaaaggttaaatagccacagaaagcctttggttagtttttggcagccaccatgaacaaagtggatcttgtcttcttacatctatgaaaatagagctttgaatggtaaggagatatgttttcttggtaaccaatgcaagattgatgggtggaaacatgattcaaacttacacaatttttcttgctatttttcaaatatgaatcttactatatattctcggtgaacatcaggagactattaaagaggtctgctgttaaatgtaaagaaaaaatgctcgtagctatttgcttcctggtattggagcagttcagttgtttagtttataccattggattcaattcattgcaccatggttgccaaaagtgcctgaggtcataatggattgttaaaataactaaattccagtggttggaaactctaggtttgtaccattttttctgctgtgggaaaaaacaacaacaacaacatgatcaaggtaacatcacatttgatgtataatattatactattaatggaatatcagtagacaactgttaacccattagtagcatgagtataaacagtacacctgaataaattggagacattagccactaggtttaacagtggaatcttgatttgcctaggtgacttctgggattactgtttgacaaataagagtaacattttatttcatttcagaatttacgtcacttttagctacaagagtaggaagaaggtaatcggcaaggcagaagagtatactctttgccttaggatagcgtaaactcaggctgagacatacccggcttatagagttcttctagatgtgtagactgtaaatgcccaaatcctctcaactaaagttttagtgattccacaaagcctctcatgtaaatttccagtgattccaccattgcacttgtgaatatgtatccttgttagtacccagggatgtcctcgagcaccagttttattttatctgccattgcatctggattccattacagcctctcagctgttactgcctgtggacagttacttctgcttactgcctgtagagagttacctaacttctcttctcagttcttcctcaggtcctggctattttggcctcagttgaagggagtcttgctctcatctctgagggttttaagtttgtttgatcccattgttgtcttttctagctttgagcatgtttttcagtattcatattttaacttactgagaacattaaagggaaatgataaactcgtggtggggatatggcagacaggtgcttgtttgtttgagagaagtagcagaagagataaaatacaaagtgctatatgtttcagctggagaggaaagagagagaatttattagattatatacttgtcccatggcataccacgtatatgtttaaatagggacacatctccctatgtttaactatacttataaacaactttgatacacattgcgtcttttattctgtcacctgatattttagtgtatctcaagttacagattacatgtgtccttaaactatttctgaatttggacttagttccatatacagaaagaactttagaaaattcattaatttggatcttctattgatagccataaatattatgtttatgtattctaaaacctctttgtttagttagtactgttcatgaatgtaacaagcttcaatttctcatttgtgagtagtacatttgctttttgtttgtttgtttgtttgtttttgagatggagtctcacgctgtcaccaggctggagtgcagtggcgcgatttcagctcactgcaacctccacctcccaggtgcaagtgatgcccctgcctcagcctcccgagtagctgggactacagacacccgccaccacacctggctaatttttgtatttttagtagagacggggtttcaccatgttggctaggctggtctcaaactcttgacctcgtgatttgcccgcctctgcctccccaaagtgctgggattacaggcgtgagccaccacgcccagccgtacatttactttttaaagcagcagactaggtacactaattctcactcaaatattttcatgggaatgtagttatcaccaagtcctaaagtattatttatgccaaaaaaaatttcattttaaggactacaaaaatgattctaattaaacattttataatcaatagtaggttgggtctttagccattatatgtgtatatatacagacacatatgtatacacttacattttgacagggtcttcattgagtcttgatgcactttaaacccagctggctaccagagatgcgaaggtgggctctttgaagattagcaaaatggacgtttctgtcacttgagaaaaggaaagttctttgcctttaaattacacagttttcatcatgcccacaatctatattattggctggttaaacagcactgccctattagcaatgttaacaaaaatgaaattatttattggcggttatagattatctaattcaggaaatttctgagctcaacttttacagcaactgttatgccttctaatttagcaattgagttatgagtaagttttgtgcttaactcctagaccctattgttgataaccagatcaaatatagtctgtacagaggaaaacactgggaacatttagtatttctaaagcctcctttggagttactactgattgtaatttggaactgataataggtagagattgctaacactgttttttttcctggatcttttttatgccagaaattaaacaggttctgctaactcttttttttctcttggttatcaccagaatgaaaatatttaaagtgatgactctagaaaagccatctgtgcctggttaacattgagtttgagtctcttcaatatatattgatcatgtattgattaatctttattttttcatattttggctagacaaattcagatctatataatggaataccccttcttgagtgaactatactactaatctacatgattatatagtaaggaaaaaagaagaaataactgtaataggcatagtgtttgttgttggttgtcttgtcattcatgtgatactactcatttccaaaattcacacaaacttacatgaggtggattatttgttttgttcattatttagttcctatatgttttttctttagaaacagagtctcattctgtcacccaggctggagtccaatggggcggtcatagttcactgcagccttgaactctttggctcatgtgatcctcccatctcagcctcccacagcaggtgagactacaggtacatgccactgtgcctgactttttaatttttttgtagagacgaggtttcagtttgttgcccaagctgatcttgaactcctggtttcaagcgatcctcccacctcggcctcccaaagtagtgggatttcaggcatgaccacctggcctagttcctatacttttcttaattcttcagacttctcacatttagtatagtgcattcatttcatcttgctgtttattagcaccctttgtggccaagggaaataaaaggtggtaaaattcagttttcagtttagttcttgaaagctctgggaaatggaggaaacacaaaactatgaattaaactagggctgttgatttctgaacccccagataaatcagttgacccacattttcattttaggtgttaggtccaaattagcataatgtcttgcattattattaggttcagtgtgaaactttacagtgctgcatttgaagtttagtaactggttattattaatcatttgggaaaaatgaaaatgtgttgggactttctatgactaggcatttgttgattatttttcatgattgctttttgttttctcattgtgtaggatttgtgaacttgtatattacaggaaacaagatactttgtaaaatttactggggaaaatccatttggagtgcatgacatttgccaggataagaaagcagtaatatgtttgtattataaaattacaccctgccagaaaactttctttcctagtaaggtaaatgtagaagggacttttacagcatagtaagttgattaggagccaaaattttattccagtttttttttgaactaagaatgttttaaattctgtaatgaacttttatgtttacccattactcatgcattctttcacaatatgtttaatagcctgaggaaataggaaagctgtgaagctactaccattctttacttttaataagaataataggaaagaaaagtcaggtcagtaatccaaatccaaatatgtatactgcaaatgctcaagaagtcacattttttgataaattgtattgagtacagaagaacttatatgaatttattatctgttaataacttagttttgacaacagaataacatttggaaattgtgagaataatcaagctgtttttccattaacagtgtaaattcataacatgtccttcaaaaggtgatattctaagctgtcttaattgtctacggttgataacttttaaataaagtacaggactttctgaaagtgtttggcatgttatgctgccaaaaacaatctgtgttttgaaataccaattaatcagttaatttctgaagactttgtataggacttgatatatgagtcagaatctgtctgtactcattctgtacattgtaactttgaacacttatgaaaaactgtatctgttggtgtgttttgattagttagtgtagatttgtttgcgtatttgaattccgattttagtttaggaagactaaaagtagccatttttgtaaagttcatatgctattttttaatgtcatttttgtttttaatatttatacaatagtgatgttactagtaaaaaatgtttatagataacacgtagagctattaactgttcaaaagcctacatgataggcatattttgtatttcgtgttgcactcgttctgtttcatattggactttttacatcccttttttagcaaaaaaaagagacacatttgaattctctttagcataaagctgtgcattggaaactatgtgactgtatccatacggttagcaaaatactctttgccaccaaaggtaaatgaaactgtaaaatacctctggatatttgtgccaatgaacttttcttagcatattaggattaaagcaaaaataatcttttcagtatgtttcatctaggacttacaataaatgtttaaaccatg

SEQ ID NO: 167866 - DNA, 8942 bp, Homo sapiens
  Payload ID: 13019
  Gene Symbol: PGAP1
  Gene Name: post-GPI attachment to proteins 1
  ENST ID: ENST00000423035
  CDS Start-End: 40-192
agagggggcggcggcggcggcggcggtggtggcggcaccatgtttcttcactcagttaatctctggaacctggcgttttatgtcttcatggtctttctggcaaccctggggctgtgggatgtcttcttcggcttcgaggagaataagtgcagtatgagctacatgtttgagtacccggagtatcagagatgagaagaacctgaactaaggcagagtcaaggaaggaggacagcagaggcaggattgtggagataatatttaaatacaaagaaaatagaacttccaaagaaactggcaaaacgctatcccgcatatgagttgtatctttatggagagggatcctatgctgaagaacacaaaattctccctttgacgggtattccagttctctttcttcctggtaatgctggaagttataagcaagttcgttctattggctccattgcacttagaaaagcagaggacattgacttcaagtaccactttgacttctttagtgtgaacttcaatgaagaactggtggctttgtatggtggaagtcttcagaagcagaccaagtttgtacatgaatgtattaaaacaattctcaaactctataagggtcaagaatttgctccaaaaagtgtggcaataattggtcattctatgggtggccttgttgcaagagcattgcttacactgaaaaattttaagcatgatctgataaatcttcttattacacaagccacacctcatgttgctcctgtgatgccattagatcgtttcattacagatttttatacgactgtaaacaactattggattctaaatgctcgacacataaatttaaccacactttctgtagctggaggattccgggattaccaagttcgttcaggattgacttttctaccaaaattaagccatcataccagtgccttatctgttgtgagttcagcagtgcctaagacctgggtctcaacagaccacctctccattgtgtggtgtaaacaattgcagttgactacagttcgagcattctttgatcttattgatgctgatactaaacaaataactcaaaattccaagaagaaactgtcagttttgtatcaccactttataagacacccatcaaaacattttgaggaaaatccagctataatttctgacttaacagggacatctatgtgggttctagtaaaagtgtccaaatggacctatgtagcttacaacgaatctgagaagatatattttacatttcctcttgaaaatcatagaaaaatctacactcatgtctattgtcagagcactatgctggatacaaatagttggatttttgcttgcataaacagcacttctatgtgcctgcaaggggttgatttatcatggaaagctgaactgctgccaacaattaagtatctgacattaagacttcaagactatccatctttgtctcatcttgttgtttatgtaccatctgttcgtggaagtaagtttgttgtagattgtgaattctttaaaaaagagaaaagatacatacagcttcctgtaactcatcttttttcctttggattgtcttcaaggaaagtggtgttaaatacaaatggcctatactacaatctagagcttctgaactttggacagatataccaagcttttaaaatcaacgtggtaagcaagtgctcagcagtcaaagaagaaataaccagtatctatagacttcatattccttggtcttatgaagattcactaaccattgcacaggctccatcttccacagaaatttctctgaaactccatattgctcaaccagaaaacaatacccatgtggcattatttaaaatgtacacgtcatcagactgtcggtacgaggtgacagttaagacttccttttcacaaatacttggacaggtagttagatttcatggtggagctcttcctgcttatgtcgtatctaatatccttcttgcttatagaggacagttatattctcttttctcaacaggttgttgcttagaatatgctaccatgttggataaagaagccaaaccatacaaagttgatccttttgtaattatcattaagtttctgttggggtataaatggtttaaagaattgtgggatgtattattgttaccagaattagatgccgtcattttaacttgtcagagtatgtgtttccccctgatatccttgattctctttctgtttggaacgtgtactgcctactggagtggcctactgtcttctgcatctgtgagacttctttcttcattgtggctagctttgaaaagaccctctgaacttcctaaagatatcaagatgatatcaccagacttgccctttttgacaattgtcttgatcatagttagttggacaacttgtggagcactagccatacttctttcttatctttactatgtgtttaaggttgttcatctgcaagccagcttaacaacttttaagaatagccagcctgtgaatcccaaacactctagaagaagtgaaaagaaatccaatcatcataaagactcctcaatacaccatcttcgtttatctgccaacgatgctgaagatagccttcgcatgcacagtactgtgattaacttactaacatggattgtattactcagcatgccttctctaatttattggctaaagaatcttaggtattattttaaacttaatcctgatccatgtaaacctttggcatttatccttattccgactatggcaattcttggaaatacttacactgtttcaataaaatcaagtaaattgttgaagactacttcacaatttccacttcctctggctgttggtgtgattgcttttgggtcagcacatttatataggcttccatgctttgtcttcattcctcttttactccatgcattatgcaactttatgtaagattggacttaaggaatgatgaagataatttatgtgtttagggccagtgataagagggaacacacagatccatcagtatggacagcaagatcctttggagaagacaagtctatttttacaatattgaaaataggaaattagttttgtaatgtttgagggaagtagttgaagcatggttttgttttgtggtgtggaatccatgtagtaatcatttttgaaaaattcatgaagggatatatggtgatcactatcattgaggactcctgtgcatataaaatagtctgttttatcaactgtacgagaagtctgatatgagagatttagtagatgcagcattatttgcagtctcactgcaagcattctgctcatttcatcaaactttttttcacaaaagtaggttattttgaatttgctatagtttacctattaagaaataagtctttaaataactgatgaaatttatagctgtttggtttctcaaaggttaaatagccacagaaagcctttggttagtttttggcagccaccatgaacaaagtggatcttgtcttcttacatctatgaaaatagagctttgaatggtaaggagatatgttttcttggtaaccaatgcaagattgatgggtggaaacatgattcaaacttacacaatttttcttgctatttttcaaatatgaatcttactatatattctcggtgaacatcaggagactattaaagaggtctgctgttaaatgtaaagaaaaaatgctcgtagctatttgcttcctggtattggagcagttcagttgtttagtttataccattggattcaattcattgcaccatggttgccaaaagtgcctgaggtcataatggattgttaaaataactaaattccagtggttggaaactctaggtttgtaccattttttctgctgtgggaaaaaacaacaacaacaacatgatcaaggtaacatcacatttgatgtataatattatactattaatggaatatcagtagacaactgttaacccattagtagcatgagtataaacagtacacctgaataaattggagacattagccactaggtttaacagtggaatcttgatttgcctaggtgacttctgggattactgtttgacaaataagagtaacattttatttcatttcagaatttacgtcacttttagctacaagagtaggaagaaggtaatcggcaaggcagaagagtatactctttgccttaggatagcgtaaactcaggctgagacatacccggcttatagagttcttctagatgtgtagactgtaaatgcccaaatcctctcaactaaagttttagtgattccacaaagcctctcatgtaaatttccagtgattccaccattgcacttgtgaatatgtatccttgttagtacccagggatgtcctcgagcaccagttttattttatctgccattgcatctggattccattacagcctctcagctgttactgcctgtggacagttacttctgcttactgcctgtagagagttacctaacttctcttctcagttcttcctcaggtcctggctattttggcctcagttgaagggagtcttgctctcatctctgagggttttaagtttgtttgatcccattgttgtcttttctagctttgagcatgtttttcagtattcatattttaacttactgagaacattaaagggaaatgataaactcgtggtggggatatggcagacaggtgcttgtttgtttgagagaagtagcagaagagataaaatacaaagtgctatatgtttcagctggagaggaaagagagagaatttattagattatatacttgtcccatggcataccacgtatatgtttaaatagggacacatctccctatgtttaactatacttataaacaactttgatacacattgcgtcttttattctgtcacctgatattttagtgtatctcaagttacagattacatgtgtccttaaactatttctgaatttggacttagttccatatacagaaagaactttagaaaattcattaatttggatcttctattgatagccataaatattatgtttatgtattctaaaacctctttgtttagttagtactgttcatgaatgtaacaagcttcaatttctcatttgtgagtagtacatttgctttttgtttgtttgtttgtttgtttttgagatggagtctcacgctgtcaccaggctggagtgcagtggcgcgatttcagctcactgcaacctccacctcccaggtgcaagtgatgcccctgcctcagcctcccgagtagctgggactacagacacccgccaccacacctggctaatttttgtatttttagtagagacggggtttcaccatgttggctaggctggtctcaaactcttgacctcgtgatttgcccgcctctgcctccccaaagtgctgggattacaggcgtgagccaccacgcccagccgtacatttactttttaaagcagcagactaggtacactaattctcactcaaatattttcatgggaatgtagttatcaccaagtcctaaagtattatttatgccaaaaaaaatttcattttaaggactacaaaaatgattctaattaaacattttataatcaatagtaggttgggtctttagccattatatgtgtatatatacagacacatatgtatacacttacattttgacagggtcttcattgagtcttgatgcactttaaacccagctggctaccagagatgcgaaggtgggctctttgaagattagcaaaatggacgtttctgtcacttgagaaaaggaaagttctttgcctttaaattacacagttttcatcatgcccacaatctatattattggctggttaaacagcactgccctattagcaatgttaacaaaaatgaaattatttattggcggttatagattatctaattcaggaaatttctgagctcaacttttacagcaactgttatgccttctaatttagcaattgagttatgagtaagttttgtgcttaactcctagaccctattgttgataaccagatcaaatatagtctgtacagaggaaaacactgggaacatttagtatttctaaagcctcctttggagttactactgattgtaatttggaactgataataggtagagattgctaacactgttttttttcctggatcttttttatgccagaaattaaacaggttctgctaactcttttttttctcttggttatcaccagaatgaaaatatttaaagtgatgactctagaaaagccatctgtgcctggttaacattgagtttgagtctcttcaatatatattgatcatgtattgattaatctttattttttcatattttggctagacaaattcagatctatataatggaataccccttcttgagtgaactatactactaatctacatgattatatagtaaggaaaaaagaagaaataactgtaataggcatagtgtttgttgttggttgtcttgtcattcatgtgatactactcatttccaaaattcacacaaacttacatgaggtggattatttgttttgttcattatttagttcctatatgttttttctttagaaacagagtctcattctgtcacccaggctggagtccaatggggcggtcatagttcactgcagccttgaactctttggctcatgtgatcctcccatctcagcctcccacagcaggtgagactacaggtacatgccactgtgcctgactttttaatttttttgtagagacgaggtttcagtttgttgcccaagctgatcttgaactcctggtttcaagcgatcctcccacctcggcctcccaaagtagtgggatttcaggcatgaccacctggcctagttcctatacttttcttaattcttcagacttctcacatttagtatagtgcattcatttcatcttgctgtttattagcaccctttgtggccaagggaaataaaaggtggtaaaattcagttttcagtttagttcttgaaagctctgggaaatggaggaaacacaaaactatgaattaaactagggctgttgatttctgaacccccagataaatcagttgacccacattttcattttaggtgttaggtccaaattagcataatgtcttgcattattattaggttcagtgtgaaactttacagtgctgcatttgaagtttagtaactggttattattaatcatttgggaaaaatgaaaatgtgttgggactttctatgactaggcatttgttgattatttttcatgattgctttttgttttctcattgtgtaggatttgtgaacttgtatattacaggaaacaagatactttgtaaaatttactggggaaaatccatttggagtgcatgacatttgccaggataagaaagcagtaatatgtttgtattataaaattacaccctgccagaaaactttctttcctagtaaggtaaatgtagaagggacttttacagcatagtaagttgattaggagccaaaattttattccagtttttttttgaactaagaatgttttaaattctgtaatgaacttttatgtttacccattactcatgcattctttcacaatatgtttaatagcctgaggaaataggaaagctgtgaagctactaccattctttacttttaataagaataataggaaagaaaagtcaggtcagtaatccaaatccaaatatgtatactgcaaatgctcaagaagtcacattttttgataaattgtattgagtacagaagaacttatatgaatttattatctgttaataacttagttttgacaacagaataacatttggaaattgtgagaataatcaagctgtttttccattaacagtgtaaattcataacatgtccttcaaaaggtgatattctaagctgtcttaattgtctacggttgataacttttaaataaagtacaggactttctgaaagtgtttggcatgttatgctgccaaaaacaatctgtgttttgaaataccaattaatcagttaatttctgaagactttgtataggacttgatatatgagtcagaatctgtctgtactcattctgtacattgtaactttgaacacttatgaaaaactgtatctgttggtgtgttttgattagttagtgtagatttgtttgcgtatttgaattccgattttagtttaggaagactaaaagtagccatttttgtaaagttcatatgctattttttaatgtcatttttgtttttaatatttatacaatagtgatgttactagtaaaaaatgtttatagataacacgtagagctattaactgttcaaaagcctacatgataggcatattttgtatttcgtgttgcactcgttctgtttcatattggactttttacatcccttttttagcaaaaaaaagagacacatttgaattctctttagcataaagctgtgcattggaaactatgtgactgtatccatacggttagcaaaatactctttgccaccaaaggtaaatgaaactgtaaaatacctctggatatttgtgccaatgaacttttcttagcatattaggattaaagcaaaaataatcttttcagtatgtttcatctaggacttacaataaatgtttaaaccatgaaaacttatatttcataccctaatttttctttgaaaatattcaagatttgtagcctagtgtgttctattttgtgtgattgcttgaatgttttctgattttattgggtaaaagtttgcctagtaatgatctttcagcaattcattgaaataattatttgaagtaatcttgcttcagatttaatttgtgatgtacattgttgtacaagccattttagtacaggtgtctcatttatgtagttgaaaggtgactgtggaatttcttttgttttttatgtatttccattcagtctctttatatagtcacatgtttcacaggggaacttgtccactggaacctaacatagtacaaccttttaatatgcgtatcttaaaggaaaatattataaaacaagatattaatactaaa

SEQ ID NO: 167867 - DNA, 2062 bp, Homo sapiens
  Payload ID: 13020
  Gene Symbol: PGAP2
  Gene Name: post-GPI attachment to proteins 2
  Uniprot ID: Q9UHJ9
  ENST ID: ENST00000278243
  CDS Start-End: 202-1149
aggggtcggggtctccagaagcggggaggagccagcggaggatctgggcgcagtttcctctctaagttccgccccgagagcgccggccccgcccccgccgttcgcgctctgaccagcccgcagagccagcccccgaccccgggccacctgggcccccgggttccgccggcactctcgccaccaccgcgtgggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggccacgccctgcaggatgttctctgcggcctcccagcctttggaccccgatgggaccttgttccggcttcgcttcacagccatggtctggtgggccatcacttttcctgtgttcggcttcttcttctgcatcatctggtccctggtgttccactttgagtacacggtggccactgactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgcta

SEQ ID NO: 167868 - DNA, 1843 bp, Homo sapiens
  Payload ID: 13020
  Gene Symbol: PGAP2
  Gene Name: post-GPI attachment to proteins 2
  Uniprot ID: Q9UHJ9
  ENST ID: ENST00000300730
  CDS Start-End: 26-949
agggcctctcgaagtgggcttgtgaatggctagattgggaagcaccggcggggtgtcgggaagggtggtgacgcaacatagagactccgcccccttccttggagcgccgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaa

SEQ ID NO: 167869 - DNA, 1837 bp, Homo sapiens
  Payload ID: 13020
  Gene Symbol: PGAP2
  Gene Name: post-GPI attachment to proteins 2
  ENST ID: ENST00000396986
  CDS Start-End: 26-961
agggcctctcgaagtgggcttgtgaatggctagattgggaagcaccggcggggtgtcgggaagggtggtgacgcaacatagagactccgcccccttccttggagcgccgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataa

SEQ ID NO: 167870 - DNA, 1798 bp, Homo sapiens
  Payload ID: 13020
  Gene Symbol: PGAP2
  Gene Name: post-GPI attachment to proteins 2
  ENST ID: ENST00000396991
  CDS Start-End: 68-886
acaggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggactgaagcttcaataggagttccaggcattaagatggatggtggagatgcacaagaacatggtcatttccttagactaccccaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgct

SEQ ID NO: 167871 - DNA, 1566 bp, Homo sapiens
  Payload ID: 13020
  Gene Symbol: PGAP2
  Gene Name: post-GPI attachment to proteins 2
  ENST ID: ENST00000396993
  CDS Start-End: 407-703
actccgcccccttccttggagcgccgcgactcgggctgagggagctcgggccaatcagagggacggccccagaatggcatggtagatggaacgcagctgagaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttattt

SEQ ID NO: 167872 - DNA, 1772 bp, Homo sapiens
  Payload ID: 13020
  Gene Symbol: PGAP2
  Gene Name: post-GPI attachment to proteins 2
  Uniprot ID: Q9UHJ9
  ENST ID: ENST00000493547
  CDS Start-End: 79-777
ccagagtttctgggatgtgcctcaccgggtctcactgcctgcaaaggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggtacggtctatccctagcgggggctccaaggcagcccagaagaaaatcaaggacatctgtcctcaggattcgggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacat

SEQ ID NO: 167873 - DNA, 1474 bp, Homo sapiens
  Payload ID: 13020
  Gene Symbol: PGAP2
  Gene Name: post-GPI attachment to proteins 2
  ENST ID: ENST00000477358
  CDS Start-End: 104-349
cttccttggagcgccgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtgggccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacatttt

SEQ ID NO: 167874 - DNA, 1815 bp, Homo sapiens
  Payload ID: 13020
  Gene Symbol: PGAP2
  Gene Name: post-GPI attachment to proteins 2
  ENST ID: ENST00000528216
  CDS Start-End: 53-223
ggagttcggggaggcacagggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggactgaagcttcaataggagttccaggcattaagatggatggtggagatgcacaagaacatggtcatttccttagactaccccaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgcta

SEQ ID NO: 167875 - DNA, 1530 bp, Homo sapiens
  Payload ID: 13020
  Gene Symbol: PGAP2
  Gene Name: post-GPI attachment to proteins 2
  ENST ID: ENST00000496834
  CDS Start-End: 362-658
cgaccccgggccacctgggcccccgggttccgccggcactctcgccaccaccgcgtgggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaa

SEQ ID NO: 167876 - DNA, 1696 bp, Homo sapiens
  Payload ID: 13020
  Gene Symbol: PGAP2
  Gene Name: post-GPI attachment to proteins 2
  ENST ID: ENST00000532523
  CDS Start-End: 133-681
ttccttggagcgccgcgactcgggctgagggagctcgggccaatcagagggacggccccagaatggcatggtagatggaacgcagctgagaggcaggttccagtctgcgggggagatggagaaggtgccaccatgctgctgcacaaatcccaggatagctggggaatgagaatccagcactttgggcctaggacctggaaggagaggtcttttgggagaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataa

SEQ ID NO: 167877 - DNA, 795 bp, Homo sapiens
  Payload ID: 13020
  Gene Symbol: PGAP2
  Gene Name: post-GPI attachment to proteins 2
  ENST ID: ENST00000459679
  CDS Start-End: 93-719
cgccgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggtacggtctatccctagcgggggctccaaggcagcccagaagaaaatcaaggacatctgtcctcaggattcgggtaatggtgaggtgggaactgagttctaatgggaaccctggcagaggggtgctggggttggggctggggcttgggaacaaactgagggtggttggtcagaatcta

SEQ ID NO: 167878 - DNA, 830 bp, Homo sapiens
  Payload ID: 13020
  Gene Symbol: PGAP2
  Gene Name: post-GPI attachment to proteins 2
  ENST ID: ENST00000464261
  CDS Start-End: 91-795
ccgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggtacggtctatccctagcgggggctccaaggcagcccagaagaaaatcaaggacatctgtcctcaggattcgggtaatggatcgcaagtcctacagctggaaacagcggctcttcatcatcaacttcatctccttcttctcggcgctggctgtctactttcggcacaacatgtattgtgaggctggagtgtacaccatctttgccatcctggagt

SEQ ID NO: 167879 - DNA, 1100 bp, Homo sapiens
  Payload ID: 13020
  Gene Symbol: PGAP2
  Gene Name: post-GPI attachment to proteins 2
  ENST ID: ENST00000465307
  CDS Start-End: 139-774
ctctcctgaacaaaggcgggaacagctctaggccagagtttctgggatgtgcctcaccgggtctcactgcctgcaaaggtagatggaacgcagctgagaggactgaagcttcaataggagttccaggcattaagatggatggtggagatgcacaagaacatggtcatttccttagactaccccaggcaggttccagtctgcgggggagatggagaaggtgccaccatgctgctgcacaaatcccaggatagctggggaatgagaatccagcactttgggcctaggacctggaaggagaggtcttttgggagaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatggg

SEQ ID NO: 167880 - DNA, 483 bp, Homo sapiens
  Payload ID: 13020
  Gene Symbol: PGAP2
  Gene Name: post-GPI attachment to proteins 2
  ENST ID: ENST00000524661
  CDS Start-End: 77-247
gagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggactgaagcttcaataggagttccaggcattaagatggatggtggagatgcacaagaacatggtcatttccttagactaccccaggttccagtctgcgggggagatggagaaggtgccaccatgctgctgcacaaatcccaggatagctggggaatgagaatccagcactttgggcctaggacctggaaggagaggtcttttgggagaggtgcccaattacctgccctcggtgagctcagcc

SEQ ID NO: 167881 - DNA, 798 bp, Homo sapiens
  Payload ID: 13020
  Gene Symbol: PGAP2
  Gene Name: post-GPI attachment to proteins 2
  ENST ID: ENST00000469307
  CDS Start-End: 64-798
ccgggccacctgggcccccgggttccgccggcactctcgccaccaccgcgtgggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcct

SEQ ID NO: 167882 - DNA, 1259 bp, Homo sapiens
  Payload ID: 13020
  Gene Symbol: PGAP2
  Gene Name: post-GPI attachment to proteins 2
  Uniprot ID: Q9UHJ9
  ENST ID: ENST00000464906
  CDS Start-End: 90-1037
cgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggccacgccctgcaggatgttctctgcggcctcccagcctttggaccccgatgggaccttgttccggcttcgcttcacagccatggtctggtgggccatcacttttcctgtgttcggcttcttcttctgcatcatctggtccctggtgttccactttgagtacacggtggccactgactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagagg

SEQ ID NO: 167883 - DNA, 863 bp, Homo sapiens
  Payload ID: 13020
  Gene Symbol: PGAP2
  Gene Name: post-GPI attachment to proteins 2
  ENST ID: ENST00000464229
  CDS Start-End: 385-669
gccgcgactcgggctgagggagctcgggccaatcagagggacggccccagaatggcatggtagatggaacgcagctgagaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtgggg

SEQ ID NO: 167884 - DNA, 931 bp, Homo sapiens
  Payload ID: 13020
  Gene Symbol: PGAP2
  Gene Name: post-GPI attachment to proteins 2
  Uniprot ID: Q9UHJ9
  ENST ID: ENST00000463452
  CDS Start-End: 84-848
cgcagagccagcccccgaccccgggccacctgggcccccgggttccgccggcactctcgccaccaccgcgtgggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccaca

SEQ ID NO: 167885 - DNA, 894 bp, Homo sapiens
  Payload ID: 13020
  Gene Symbol: PGAP2
  Gene Name: post-GPI attachment to proteins 2
  ENST ID: ENST00000479072
  CDS Start-End: 490-774
cgaccccgggccacctgggcccccgggttccgccggcactctcgccaccaccgcgtgggcaggttccagtctgcgggggagatggagaaggtgccaccatgctgctgcacaaatcccaggatagctggggaatgagaatccagcactttgggcctaggacctggaaggagaggtcttttgggagaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaa

SEQ ID NO: 167886 - DNA, 810 bp, Homo sapiens
  Payload ID: 13020
  Gene Symbol: PGAP2
  Gene Name: post-GPI attachment to proteins 2
  ENST ID: ENST00000490830
  CDS Start-End: 384-620
ccgcgactcgggctgagggagctcgggccaatcagagggacggccccagaatggcatggtagatggaacgcagctgagaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggtacggtctatccctagcgggggctccaaggcagcccagaagaaaatcaaggacatctgtcctcaggattcgggtaatggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaa

SEQ ID NO: 167887 - DNA, 699 bp, Homo sapiens
  Payload ID: 13020
  Gene Symbol: PGAP2
  Gene Name: post-GPI attachment to proteins 2
  ENST ID: ENST00000464441
  CDS Start-End: 84-380
agaatggcatggtagatggaacgcagctgagagccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttaca

SEQ ID NO: 167888 - DNA, 745 bp, Homo sapiens
  Payload ID: 13020
  Gene Symbol: PGAP2
  Gene Name: post-GPI attachment to proteins 2
  ENST ID: ENST00000475884
  CDS Start-End: 69-314
tcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtgggccatccacgaaaatgctttcattgtgttcattgcctcatccctcgggcacatgctcctcacctgcattctctggcggttgaccaagaagcacacagatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccaccc

SEQ ID NO: 167889 - DNA, 1513 bp, Homo sapiens
  Payload ID: 13020
  Gene Symbol: PGAP2
  Gene Name: post-GPI attachment to proteins 2
  ENST ID: ENST00000532017
  CDS Start-End: 145-315
attcgaccctttccttgccccggtccgccggcgctgctgggaaggcttcctagtctctctgcccgcacttcccgcccagaccacgtgcggagcctgagggccctcttggaaggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggactgaagcttcaataggagttccaggcattaagatggatggtggagatgcacaagaacatggtcatttccttagactaccccaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggagtggaagcggcaggaataccactgctcctcggcccatcactcccccagaggcagggacgtgaacacatagtcgtcattcttgctgcccctgcctgtgctcccttccatgaccgctagtgggagccaagggagataaggcccagcccttaggagttagggctgagaggggagcccacgctctcatacccagcaagctgcagagtgatcagacagcccattccctaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgacc

SEQ ID NO: 167890 - DNA, 879 bp, Homo sapiens
  Payload ID: 13020
  Gene Symbol: PGAP2
  Gene Name: post-GPI attachment to proteins 2
  ENST ID: ENST00000489571
  CDS Start-End: 175-345
gagggacggccccagaatggcatggtaactattcgaccctttccttgccccggtccgccggcgctgctgggaaggcttcctagtctctctgcccgcacttcccgcccagaccacgtgcggagcctgagggccctcttggaaggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggactgaagcttcaataggagttccaggcattaagatggatggtggagatgcacaagaacatggtcatttccttagactaccccaggcaggttccagtctgcgggggagatggagaaggtgccaccatgctgctgcacaaatcccaggatagctggggaatgagaatccagcactttgggcctaggacctggaaggagaggtcttttgggagaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctgg

SEQ ID NO: 167891 - DNA, 2737 bp, Homo sapiens
  Payload ID: 13021
  Gene Symbol: PGAP3
  Gene Name: post-GPI attachment to proteins 3
  Uniprot ID: Q96FM1
  ENST ID: ENST00000300658
  CDS Start-End: 94-1056
gtagaataaagaacacaggaacttccggttactccggaagtggaagcttcatactcctaagctcctcccccggcggcgagccagggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctgggtgtccctcaatgcatggttctggtccacagttttccacaccagggacactgacctcacagagaaaatggactacttctgtgcctccactgtcatcctacactcaatctacctgtgctgcgtcaggaccgtggggctgcagcacccagctgtggtcagtgccttccgggctctcctgctgctcatgctgaccgtgcacgtctcctacctgagcctcatccgcttcgactatggctacaacctggtggccaacgtggctattggcctggtcaacgtggtgtggtggctggcctggtgcctgtggaaccagcggcggctgcctcacgtgcgcaagtgcgtggtggtggtcttgctgctgcaggggctgtccctgctcgagctgcttgacttcccaccgctcttctgggtcctggatgcccatgccatctggcacatcagcaccatccctgtccacgtcctctttttcagctttctggaagatgacagcctgtacctgctgaaggaatcagaggacaagttcaagctggactgaagaccttggagcgagtctgccccagtggggatcctgcccccgccctgctggcctcccttctcccctcaacccttgagatgattttctcttttcaacttcttgaacttggacatgaaggatgtgggcccagaatcatgtggccagcccaccccctgttggccctcaccagccttggagtctgttctagggaaggcctcccagcatctgggactcgagagtgggcagcccctctacctcctggagctgaactggggtggaactgagtgtgctcttagctctaccgggaggacagctgcctgtttcctccccatcagcctcctccccacatccccagctgcctggctgggtcctgaagccctctgtctacctgggagaccagggaccacaggccttagggatacagggggtccccttctgttaccaccccccaccctcctccaggacaccactaggtggtgctggatgcttgttctttggccagccaaggttcacggcgattctccccatgggatcttgagggaccaagctgctgggattgggaaggagtttcaccctgaccattgccctagccaggttcccaggaggcctcaccatactccctttcagggccagggctccagcaagcccagggcaaggatcctgtgctgctgtctggttgagagcctgccaccgtgtgtcgggagtgtgggccaggctgagtgcataggtgacagggccgtgagcatgggcctgggtgtgtgtgagctcaggcctaggtgcgcagtgtggagacgggtgttgtcggggaagaggtgtggcttcaaagtgtgtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaaggcgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgcgccctggtaaaggtgacccctgccatttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctca

SEQ ID NO: 167892 - DNA, 2533 bp, Homo sapiens
  Payload ID: 13021
  Gene Symbol: PGAP3
  Gene Name: post-GPI attachment to proteins 3
  Uniprot ID: Q96FM1
  ENST ID: ENST00000378011
  CDS Start-End: 44-853
atactcctaagctcctcccccggcggcgagccagggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaaggtgtccctcaatgcatggttctggtccacagttttccacaccagggacactgacctcacagagaaaatggactacttctgtgcctccactgtcatcctacactcaatctacctgtgctgcgtcaggaccgtggggctgcagcacccagctgtggtcagtgccttccgggctctcctgctgctcatgctgaccgtgcacgtctcctacctgagcctcatccgcttcgactatggctacaacctggtggccaacgtggctattggcctggtcaacgtggtgtggtggctggcctggtgcctgtggaaccagcggcggctgcctcacgtgcgcaagtgcgtggtggtggtcttgctgctgcaggggctgtccctgctcgagctgcttgacttcccaccgctcttctgggtcctggatgcccatgccatctggcacatcagcaccatccctgtccacgtcctctttttcagctttctggaagatgacagcctgtacctgctgaaggaatcagaggacaagttcaagctggactgaagaccttggagcgagtctgccccagtggggatcctgcccccgccctgctggcctcccttctcccctcaacccttgagatgattttctcttttcaacttcttgaacttggacatgaaggatgtgggcccagaatcatgtggccagcccaccccctgttggccctcaccagccttggagtctgttctagggaaggcctcccagcatctgggactcgagagtgggcagcccctctacctcctggagctgaactggggtggaactgagtgtgctcttagctctaccgggaggacagctgcctgtttcctccccatcagcctcctccccacatccccagctgcctggctgggtcctgaagccctctgtctacctgggagaccagggaccacaggccttagggatacagggggtccccttctgttaccaccccccaccctcctccaggacaccactaggtggtgctggatgcttgttctttggccagccaaggttcacggcgattctccccatgggatcttgagggaccaagctgctgggattgggaaggagtttcaccctgaccattgccctagccaggttcccaggaggcctcaccatactccctttcagggccagggctccagcaagcccagggcaaggatcctgtgctgctgtctggttgagagcctgccaccgtgtgtcgggagtgtgggccaggctgagtgcataggtgacagggccgtgagcatgggcctgggtgtgtgtgagctcaggcctaggtgcgcagtgtggagacgggtgttgtcggggaagaggtgtggcttcaaagtgtgtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaaggcgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgcgccctggtaaaggtgacccctgccatttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctc

SEQ ID NO: 167893 - DNA, 970 bp, Homo sapiens
  Payload ID: 13021
  Gene Symbol: PGAP3
  Gene Name: post-GPI attachment to proteins 3
  Uniprot ID: Q96FM1
  ENST ID: ENST00000429199
  CDS Start-End: 44-943
atactcctaagctcctcccccggcggcgagccagggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctggaaaatggactacttctgtgcctccactgtcatcctacactcaatctacctgtgctgcgtcaggaccgtggggctgcagcacccagctgtggtcagtgccttccgggctctcctgctgctcatgctgaccgtgcacgtctcctacctgagcctcatccgcttcgactatggctacaacctggtggccaacgtggctattggcctggtcaacgtggtgtggtggctggcctggtgcctgtggaaccagcggcggctgcctcacgtgcgcaagtgcgtggtggtggtcttgctgctgcaggggctgtccctgctcgagctgcttgacttcccaccgctcttctgggtcctggatgcccatgccatctggcacatcagcaccatccctgtccacgtcctctttttcagctttctggaagatgacagcctgtacctgctgaaggaatcagaggacaagttcaagctggactgaagaccttggagcgagtctgccccagtg

SEQ ID NO: 167894 - DNA, 804 bp, Homo sapiens
  Payload ID: 13021
  Gene Symbol: PGAP3
  Gene Name: post-GPI attachment to proteins 3
  ENST ID: ENST00000584620
  CDS Start-End: 1-452
cggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctggatgagaaaactgaggcacagcaaggctaaataacttgcccaaggacacacaggaaatgcagagccaggaactgaaccctggcagtctggctgtagggcttgcattcttaatgataccactacctcccaaatctgaggaaagggtgtccctcaatgcatggttctggtccacagttttccacaccagggacactgacctcacagagaaaatggactacttctgtgcctccactgtcatcctacactcaatctacctgtgctgcgtcaggtgagcctgcctgggtggctgcaggggcaaaatcgaaccctgggggcagaaaggggtcacccagccttcccctgggggccttcttcactagtctcccaacacctacgccccccaaccc

SEQ ID NO: 167895 - DNA, 2220 bp, Homo sapiens
  Payload ID: 13021
  Gene Symbol: PGAP3
  Gene Name: post-GPI attachment to proteins 3
  ENST ID: ENST00000579146
  CDS Start-End: 44-490
atactcctaagctcctcccccggcggcgagccagggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctggctttctggaagatgacagcctgtacctgctgaaggaatcagaggacaagttcaagctggactgaagaccttggagcgagtctgccccagtggggatcctgcccccgccctgctggcctcccttctcccctcaacccttgagatgattttctcttttcaacttcttgaacttggacatgaaggatgtgggcccagaatcatgtggccagcccaccccctgttggccctcaccagccttggagtctgttctagggaaggcctcccagcatctgggactcgagagtgggcagcccctctacctcctggagctgaactggggtggaactgagtgtgctcttagctctaccgggaggacagctgcctgtttcctccccatcagcctcctccccacatccccagctgcctggctgggtcctgaagccctctgtctacctgggagaccagggaccacaggccttagggatacagggggtccccttctgttaccaccccccaccctcctccaggacaccactaggtggtgctggatgcttgttctttggccagccaaggttcacggcgattctccccatgggatcttgagggaccaagctgctgggattgggaaggagtttcaccctgaccattgccctagccaggttcccaggaggcctcaccatactccctttcagggccagggctccagcaagcccagggcaaggatcctgtgctgctgtctggttgagagcctgccaccgtgtgtcgggagtgtgggccaggctgagtgcataggtgacagggccgtgagcatgggcctgggtgtgtgtgagctcaggcctaggtgcgcagtgtggagacgggtgttgtcggggaagaggtgtggcttcaaagtgtgtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaaggcgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgcgccctggtaaaggtgacccctgccatttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctca

SEQ ID NO: 167896 - DNA, 538 bp, Homo sapiens
  Payload ID: 13021
  Gene Symbol: PGAP3
  Gene Name: post-GPI attachment to proteins 3
  ENST ID: ENST00000584856
  CDS Start-End: 328-538
aggaaagctactgtggacgccatgcttcattggaccctactctgtgccactctgacctacagccacgttcctcagaacactgagtccccaagactccagaggaggcaggtgttatcattccccattttgcagaagaggaaccttgagccttgagattccacgagctaaaggaactttcccaaggtcacagagctgagctgggaactgagccatggcagatttggcttcacccattaccctcaagagccccagtcaagggtaccaagaggggagacagaggaaagaagtccaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcg

SEQ ID NO: 167897 - DNA, 587 bp, Homo sapiens
  Payload ID: 13021
  Gene Symbol: PGAP3
  Gene Name: post-GPI attachment to proteins 3
  ENST ID: ENST00000577337
  CDS Start-End: 1-135
tcgtttctcaatggcctggccagcctggtgatgctctgccgctaccgcaccttcgtgccagcctcctcccccatgtaccacacctgtgtggccttcgcctggatgagaaaactgaggcacagcaaggctaaataacttgcccaaggacacacaggaaatgcagagccaggaactgaaccctggcagtctggctgtagggcttgcattcttaatgataccactacctcccaaatctgaggaaagggtgtccctcaatgcatggttctggtccacagttttccacaccagggacactgacctcacagagaaaatggactacttctgtgcctccactgtcatcctacactcaatctacctgtgctgcgtcaggaccgtggggctgcagcacccagctgtggtcagtgccttccgggctctcctgctgctcatgctgaccgtgcacgtctcctacctgagcctcatccgcttcgactatggctacaacctggtggccaacgtggctattggcctggtcaacgtggtgtggtggctggcctggtgcctgtggaaccagcggcggctgcctcacgtgcgcaagtgcgtggtgg

SEQ ID NO: 167898 - DNA, 2094 bp, Homo sapiens
  Payload ID: 13021
  Gene Symbol: PGAP3
  Gene Name: post-GPI attachment to proteins 3
  ENST ID: ENST00000619169
  CDS Start-End: 526-1248
cctgtgtggccttcgcctgggtgtccctcaatgcatggttctggtccacagttttccacaccagggacactgacctcacagagaaaatggactacttctgtgcctccactgtcatcctacactcaatctacctgtgctgcgtcaggcctggtcaacgtggtgtggtggctggcctggtgcctgtggaaccagcggcggctgcctcacgtgcgcaagtgcgtggtggtggtcttgctgctgcaggggctgtccctgctcgagctgcttgacttcccaccgctcttctgggtcctggatgcccatgccatctggcacatcagcaccatccctgtccacgtcctctttttcagctttctggaagatgacagcctgtacctgctgaaggaatcagaggacaagttcaagctggactgaagaccttggagcgagtctgccccagtggggatcctgcccccgccctgctggcctcccttctcccctcaacccttgagatgattttctcttttcaacttcttgaacttggacatgaaggatgtgggcccagaatcatgtggccagcccaccccctgttggccctcaccagccttggagtctgttctagggaaggcctcccagcatctgggactcgagagtgggcagcccctctacctcctggagctgaactggggtggaactgagtgtgctcttagctctaccgggaggacagctgcctgtttcctccccatcagcctcctccccacatccccagctgcctggctgggtcctgaagccctctgtctacctgggagaccagggaccacaggccttagggatacagggggtccccttctgttaccaccccccaccctcctccaggacaccactaggtggtgctggatgcttgttctttggccagccaaggttcacggcgattctccccatgggatcttgagggaccaagctgctgggattgggaaggagtttcaccctgaccattgccctagccaggttcccaggaggcctcaccatactccctttcagggccagggctccagcaagcccagggcaaggatcctgtgctgctgtctggttgagagcctgccaccgtgtgtcgggagtgtgggccaggctgagtgcataggtgacagggccgtgagcatgggcctgggtgtgtgtgagctcaggcctaggtgcgcagtgtggagacgggtgttgtcggggaagaggtgtggcttcaaagtgtgtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaaggcgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgcgccctggtaaaggtgacccctgccatttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctc

SEQ ID NO: 167899 - DNA, 2632 bp, Homo sapiens
  Payload ID: 13021
  Gene Symbol: PGAP3
  Gene Name: post-GPI attachment to proteins 3
  ENST ID: ENST00000614824
  CDS Start-End: 12-971
agggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctgggtgtccctcaatgcatggttctggtccacagttttccacaccagggacactgacctccagagaaaatggactacttctgtgcctccactgtcatcctacactcaatctacctgtgctgcgtcaggaccgtggggctgcagcacccagctgtggtcagtgccttccgggctcctgctgctcatgctgaccgtgcacgtctcctacctgagcctcatccgcttcgactatggctacaacctggtggccaacgtggctattggcctggtcaacgtggtgtggtggctggcctggtgcctgtggaaccagcggcggctgcctcacgtgcgcaagtgcgtggtggtggtcttgctgctgcaggggctgtccctgctcgagctgcttgacttcccaccgctcttctgggtcctggatgcccatgccatctggcacatcagcaccatccctgtccacgtcctctttttcagctttctggaagatgacagcctgtacctgctgaaggaatcagaggacaagttcaagctggactgaagaccttggagcgagtctgccccagtggggatcctgcccccgccctgctggcctcccttctcccctcaacccttgagatgattttctcttttcaacttcttgaacttggacatgaaggatgtgggcccagaatcatgtggccagcccaccccctgttggccctcaccagccttggagtctgttctagggaaggcctcccagcatctgggactcgagagtgggcagcccctctacctcctggagctgaactggggtggaactgagtgtgctcttagctctaccgggaggacagctgcctgtttcctccccatcagcctcctccccacatccccagctgcctggctgggtcctgaagccctctgtctacctgggagaccagggaccacaggccttagggatacagggggtccccttctgttaccaccccccaccctcctccaggacaccactaggtggtgctggatgcttgttctttggccagccaaggttcacggcgattctccccatgggatcttgagggaccaagctgctgggattgggaaggagtttcaccctgaccattgccctagccaggttcccaggaggcctcaccatactccctttcagggccagggctccagcaagcccagggcaaggatcctgtgctgctgtctggttgagagcctgccaccgtgtgtcgggagtgtgggccaggctgagtgcataggtgacagggccgtgagcatgggcctgggtgtgtgtgagctcaggcctaggtgcgcagtgtggagacgggtgttgtcggggaagaggtgtggcttcaaagtgtgtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaaggcgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgcgccctggtaaaggtgacccctgccatttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaa

SEQ ID NO: 167900 - DNA, 7568 bp, Homo sapiens
  Payload ID: 13022
  Gene Symbol: KCMF1
  Gene Name: potassium channel modulatory factor 1
  Uniprot ID: Q9P0J7
  ENST ID: ENST00000409785
  CDS Start-End: 360-1505
gcggggggtgggccgggggaggggaggagcgggatttgcggagcgccgcgccgctgccgggagccggcaggcccgagagtgaccggagtcacggcgggcgccggcggagctgcggcgtcggacccgcctcctggaggagctcagccccgaccaggcccggccccattcccgccccgcgccgcctccccgccgccgccgccgccgccgccgcgggagcgctcccctgcccaccccgcccccgcggccgagcccgggagtcgagtgggagtcggccggccggcgcgggcagcgccgggaccccgcgggggacactgcagccggagcccgggaggggccgcgccgccaccgtctgaactaggatgtcccgacatgaaggtgtcagctgtgatgcatgtttaaaaggaaattttcgaggtcgcagatataagtgtttaatttgctacgattacgatctttgtgcatcttgttatgaaagtggtgcaacaacaacaaggcatacaactgaccacccaatgcagtgcatattaacaagggtagattttgatttatactatggtggggaagctttctctgtagagcagccacagtcttttacttgtccctattgtggaaaaatgggctatacggagacatctcttcaagaacatgttacttctgaacatgcagaaacatcaacagaagtgatttgtccaatatgtgcagcgttacctggaggcgatcctaatcatgtcacggatgactttgcagctcatcttacacttgaacacagagcccctagagatttagatgaatcgagtggtgttcgacatgtacgtagaatgtttcaccctggccggggattaggaggtcctcgtgctcgtagatcaaacatgcactttactagcagttctactggtggactttcttcttctcagagttcatattctccaagcaatagggaagccatggatcctatagctgagcttttatctcagttatcaggagtgagacgttctgcaggaggacagcttaattcctctggcccttccgcttctcagttacaacaactgcagatgcagctgcagctagaacggcagcatgcccaggcagcacggcaacaactggagaccgcacgcaacgcaacccggcgtactaacacaagcagtgtcaccactacaatcacacaatccacagcaacaaccaacatagctaatacagaaagcagtcagcagactctacagaattcccagtttcttttaacaaggttgaatgatcctaaaatgtctgaaacggagcgccagtccatggaaagcgagcgtgcagaccgcagcctgtttgtccaagagctccttctgtccactttagtgcgtgaagagagctcatcctcagatgaggatgatcggggggagatggcagattttggtgctatgggctgtgtagatattatgcctttagatgttgctttagaaaacctaaatttaaaagagagtaataaaggaaatgagcctccaccacctcctctttgatgacatcccaattcgcagacaatgtcctctgtgctgtatttgccaatgaaagtggacaacaactatcttgggtttgtttggtgattgtaatttcaggtctgtcactcttgttacattgtgtacattcaaaaggaagagagaaaatatatatgataatcatttccacttaactaatttttacttctagcaggtaaatgtaggtagcagtgcaggggtgatctctgcttcctgtaccttgacatgcaaaaggctctcctaatactccacattcaaactgaagaggaaaattgaaatctctaatgaagctgctgtgtgtatttatgaatattaatgaataaaaactgcttggatggtttaccttaactactgcatgaggttttttgcagcgtgcatgagttttagtgaccttgttatttaagaagttaaatacaaggagtaaaacttaaaaaaaaaatacaaagcccaaagctttcccaaacattattcaatggttacacgacgaagtagcttttgaataatgtctgcctgaatcacctttctttgtgtgcctcctacgcacaaagccagctctgcagtggaatctggggattatagccgggtgtggcactccgccctgtgtgactgtcctgtcgccctgttagtcatcttgcctgtgtggagctcagcctgtctctttaactcatctgtagaagacacaccagtaaagctactgttggaatctgctgcaggggcctttgtgtgccctaaaaacaaatcctgttcatgtttgtttaaagtttttactttttgtggttgtttaaaattttttcaattgttaaatatgttttattcaggtgtagatgaatttcatttattgactgttcaacagagttaacctgaattatgttgtctttgtttttaaaaatctcacattctcaatcatattttgcattatttatgtatttgctttgtagtttgctgagacagatcagtatcaggggagctttgaggatttgccttcccagatttgtcagtatattacaaccaaattcttaatgctaattttagcaccttttatttattgggttttttctggcataaaaagtaaagccttttaattgaatcatgccacctatatgcctatattattaatcctatgtgtaaaaaaaatgtacagctttttttgggtttgttttggggtttggaagggccgggttattttttatttcctgtttcagtttttgtgcatagactttcacaatagctccaaggcagggacagcgggtttgggggttgggagggcagtttttggaatgtaaatttaggacttttaaaaaggtgcgcacagcttctgataaatttataactagacttaacctaatcatgtctcgttccagttctcttttctctgagcccttttcaaagtctcctctctttctcctgtcatccttttcctttcctgtccgtgtatctccgtttcttcaacatgacaagcatacagacttgaacacccctccggtgttcttccgagaactgtgaagtccatgttcatccaaatgtaaccaaaaaagaagtcaccctacatgtctgaaaaactgttgcttctcctctgaaacttcaaactccaacgatttccaaatacaatagctttgttttctttagttctgtaatggataatgtttaaaggaaaactttacaccaggcttctggttacactagaagtcaagcccattagggattttcattttttttcatttggttgttgagaagtttcaaaaatcagttttcaagctgtggtctttcaaacacatctgcacataagtcacacatttcaataaagcattttcaagactgttgaccacttgaatttctttggtgttagtggattaacctaaccattactctgagattttatatctctaatccagtattttttttctttttatgctaaacatgggagatcctggttttgtgtgaatgcattattttggatgtgagaaataaatgccaattatatgtactttcccttttctgcacaaattctgggaaaatgtaaaagccttcattttttaacatggttttagggaacaactgtaagtccattcagagcagtttaatttagatgatcacttttaacactgcagaagacctaaggagtcataagattccatctcatgtagaatactgtatattaattattttttaccagatattttacaaatacctcacctcatcctgtatgtaatcaataatgtattattttagggtagaacgacacagaatatcaatataaaaatatattcaagcccttgaaattcttgtgtcctttttctttagtttctgaatgaaaatcttattactggatgtactattgaataaaaattaattgcaaagactttgatggagacaaaatcaaaatataccactgtttattttggcagcaccttcaaatttctaaggaccagatcctgaattttgagaattttttgtttcgttgagttttgagtgtctaggatataagtttataaatgttctacagtgcttgtctttacttcctgtttagaaatcatttaaatctttcccctcgaggtgctctggaagaagtttaatttcagctctgaacaagtagaaataactgtgcttccttgtatggctgcaatcataagacagaatttctgtggttggctaccgtgaaatctttgtatttatattgcattgttttgttaaaaaaaaaaaaatccacagaagtagaacctaggtttgctactaacaaagtagtggattcttataattaggctcaggtaaagtaagagaaaacttctctccctgtggcccccagagaaatgaagtaggatagcagattacactattagaaataatagacgtaacaaaaaaaatccagcccattatccccaccccccattttccctctcaatattagaaatttcaataatatgctgacagattttcaaaggtcaccaaggcttttgtgtttttttccggtctgtgggccacagttaaaagaacgggtaacaggttcagagttctcttgatacgtccaagccttagtttccaggaaaaaagctaggctcctcactgcaaatattaacgctttatatatttactccatggatgttggggtaagcacatatatcaatagttcatagctctagttaaggacaaagtgggttggggggtagaaggagaatactagagaggttacggtagcaggtggctgcagaaaagaatcttttgaatgggattcctgtaacagtgttcagtaccaatattaagtctactgtaagtggggtctgatatggcttactgatacaggcatgtgtaaaaaactaagtgtgatggaggaatgggtgctaaaagctcttaacagttttgtagagaagccctgcagccgtgtttactatatatgacatgcctgtttcttagtttgcatgcacagtttaaggggcacatgcaatattggtttcatgtgcagtaaaaattaaaacacggctgagcgtggtggctcacgcctgtaatcccagcactttgcgaggccgaggcgggtggatcacgaggtcgagtttgagaccattttggccagcatagtgaaaccccatctctactaaaaaatacaaaaagttagctgggcatggtggcaggcacctgtaatcccagctactcgggaggctgaggcaggagaatcgcttgaacctgggaggcagaggttgcagtgagctgagatcacgccgccattgcactccagcccgggcgacggtgcaagactctgtctcaaaaaaaaaaaaaattaaaacactaggtacgaaattatcccagaattatacgcgaaagttggtgttcatgctggaaaacagttacggttatctgtgctctttctaaagctcaactagacactaaaacagttctctccttgagaccggaagtgggatgggggtgggcaggtggaagggaagaggctggggaggagcctctcatctcatctcatttcagcctcaacagtaattgaaaccctatgcctggcctggagtgggtagaggttagggttagagtgcaggatggagcagcagtctgcagactttcaggttgtgacgatgtcatgaaattctgtgctattaaacatggctatgtctgagtcagtcattacggtattccaaagccaaattcaagtgactgtttttctgaatagtataaaaatctaattccctgtgcttatcggcttcaactgtgcttacacaacgtttgtttctaattcgtactcttgcctcttggtttctgtagtttttcaacccatttctgtcagtgttctataaatgcatacattcgttatttaaggaaccctgcagcagacctcgaataaaatgtgacttgatgtttgttgccacttcctcaacttggttagcaaattcaagttttgaaagacgattcgtctcagagaagttgatcctgaacctccacgtcacattttagtcggttgctattaggtgggtaatgcctaataacatgggttcctcaaatcacaaaggagaatgctctcaagtcctcatgttaactttagtaagtcagttaactttacagcaactaaagagatcaattaaaaagaacccttaagtctgactgtcccaggtaactttacttgctgtacagatagtgcacagatatggatgagggctgcacatggctgatttgaaaacccatgtggggccgggtgtggtggctcacgcctgtaatcccagcactttgggaggccaaggcgggtggatcacgaggttagttcaggaccagcctggccaagatggtgaaaccccatctctactaaaaatacgaaaattagctgggcttggtggcagatgcctgtaattcctgctactcgggaggctgaggcagagaattgcttgaacccgggaggcggaggttgcagtgagccgagattgcgccactgcactccagcctgggcgacacagtgagactctcctcaaaacaaaaaaaaaagaaagaaaacccatgtgggccgcatgtgcacagcctggggctgctttccacaggcctggataatgatgtttctcttcaaggaggcctttactaaccacagggaacctagcatctgactgtgtccttggcagacagtgcatgtagcctgtagaatgttggctcctctgtctatagaaaccatcagttcgctgctctctcattcatacatactttttgagttcccagtaggtacgaagctttgtctaaacattatttaccaactgcgatttttacagacttcccctgtaagaattttctaaaagagcctttctcccttacacaattgaaacgttttcaaaggtcatcaagccggttgcgtttggtcagtcacgtgaccaatcagagctggtgagtgagctgctcccttaaatctaccaaattagactgacagcatttggaatctgcctcacacataagagatccatattcatttaatagtgaagccagcccagaagcatcctcttctgtaagctggatggagtcccagctctctctccttgtatataaggagaccacaccctgtatataaggttttcttgaggtagatgcagcaatattcctggggtaagattctataatactcctgtattggcaagtggactggaccaacagacacaggcctcagccactgtcgctagggactgaaggagagttcatggattcttaccccctagtcatgaaagctattctggccagccttgaatccatttaattttgcccacgagaacctttcatgacaattaacaagacactagtttccccataaaagtccatttttaaatatatagtatgctaattagcagtgtctgttgaattgccctatcggatagcagccaccatgtgtgctgaccactcacgattcagacttaccttggaaaatatcacactgacgatacagtactttagaataaattgcatattgtatcaggctccgagactaatttgtactgaacccttgatatagattaccttttataacatcaccacctgtcatgaagcttatctgttttctgatttgaataaactttgtgttgtgca

SEQ ID NO: 167901 - DNA, 625 bp, Homo sapiens
  Payload ID: 13022
  Gene Symbol: KCMF1
  Gene Name: potassium channel modulatory factor 1
  ENST ID: ENST00000453448
  CDS Start-End: 178-625
atgtgctgcctaccagaccaggttttggaaaatgacgatggtgtcagctgtgatgcatgtttaaaaggaaattttcgaggtcgcagatataagtgtttaatttgctacgattacgatctttgtgcatcttgttatgaaagtggtgcaacaacaacaaggcatacaactgaccacccaatgcagtgcatattaacaagggtagattttgatttatactatggtggggaagctttctctgtagagcagccacagtcttttacttgtccctattgtggaaaaatgggctatacggagacatctcttcaagaacatgttacttctgaacatgcagaaacatcaacagaagtgatttgtccaatatgtgcagcgttacctggaggcgatcctaatcatgtcacggatgactttgcagctcatcttacacttgaacacagagcccctagagatttagatgaatcgagtggtgttcgacatgtacgtagaatgtttcaccctggccggggattaggaggtcctcgtgctcgtagatcaaacatgcactttactagcagttctactggtggactttcttcttctcagagttcatattctccaagcaatagggaagccatggatcctatagctg

SEQ ID NO: 167902 - DNA, 560 bp, Homo sapiens
  Payload ID: 13022
  Gene Symbol: KCMF1
  Gene Name: potassium channel modulatory factor 1
  ENST ID: ENST00000428691
  CDS Start-End: 420-560
gagtgtccccgcctgcgggcgaccgcggggctggcgggaaggctctgcggccaagggacgggaagccctcgccgcctggagcccgccccggcctcgcggctaggcctcggcgcgtccctgggctcgggtaaccaagttcccggggtggatccgaccccgccgcagcaagcaaactccctgctcagtcacccaggcggagcagggctcgctccccgcggccctggtgccctcgccggcatgtgctgcctaccagaccaggttttggaaaatgacgatggtgaggtgtcagctgtgatgcatgtttaaaaggaaattttcgaggtcgcagatataagtgtttaatttgctacgattacgatctttgtgcatcttgttatgaaagtggtgcaacaacaacaaggcatacaactgaccacccaatgcagtgcatattaacaagggtagattttgatttatactatggtggggaagctttctctgtagagcagccacagtcttttacttgtccctattgtggaaaaatgggctatacggagacatctcttcaagaacatgttact

SEQ ID NO: 167903 - DNA, 661 bp, Homo sapiens
  Payload ID: 13022
  Gene Symbol: KCMF1
  Gene Name: potassium channel modulatory factor 1
  ENST ID: ENST00000456682
  CDS Start-End: 631-661
gcggggggtgggccgggggaggggaggagcgggatttgcggagcgccgcgccgctgccgggagccggcaggcccgagagtgaccggagtcacggcgggcgccggcggagctgcggcgtcggacccgcctcctggaggagctcagccccgaccaggcccggccccattcccgccccgcgccgcctccccgccgccgccgccgccgccgccgcgggagcgctcccctgcccaccccgcccccgcggccgagcccgggagtcgagtgggagtcggccggccggcgcgggcagcgccgggaccccgcgggggacactgcagccggagcccgggaggggccgcgccgccaccgtctgaactaggatgtcccgacatgaaggccagaggtccctgttgctgtgcatatattattagccgagtatatgatgggaaggctttctaaacagctcttagaccctgttttcagtgctcagtggtacacagtctttgcattgcctgtgtcagctgtgatgcatgtttaaaaggaaattttcgaggtcgcagatataagtgtttaatttgctacgattacgatctttgtgcatcttgttatgaaagtggtgcaacaacaacaaggcatacaactgaccacccaatgcagtgcatattaacaagggtagattttg

SEQ ID NO: 167904 - DNA, 1527 bp, Homo sapiens
  Payload ID: 13023
  Gene Symbol: KCNRG
  Gene Name: potassium channel regulator
  Uniprot ID: Q8N5I3
  ENST ID: ENST00000312942
  CDS Start-End: 241-1059
agttcctcatctgttgctttttcattttgtatactgcaagttcccaggcaactcgaatttgcaaacacagccatggatacactatttaccttacagtagtttcctgggaatctaagtctggtttttgttattcttccctcccctccactgcataatcatgtataactagcaacatttatggttataggttgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtatgtttctataaaacctgataaccgaaaattggccaacggaacaaatgtcctcggcttactgattgacactttattaaaggaaggctttcatttggtcagcactagaacagtatcttctgaagacaaaactgaatgctatagctttgaaaggataaaaagccctgaagtgctcatcacgaatgaaacaccaaaaccagagactatcatcataccagagcaatctcagataaagaaatgaagttgtctatcctcttttaaagagaaattgccatttttcttgtttcattacgtatttagggcatacatgttagccaaatctacactcagcctaactcttggcttcatctgctgccatgccgtctctgggcaaccaggccccaactgtgcttaagccataatgcctgctgctctctagacaactccatgtacttggtgctttggtatatgttctaccttcaatacatctttccctttctcttcttcatgaatgcttatgagccgagattgcgccactgcacactagcttgggtgacagaggaagactgtctcaaaaaaaaaaaaattgatcaaactgatggataccctaagtaccctgacttgatcattacaccttctatgcatgcaacaaaatgccacgtgtaccccataaatatgtagaaatattatatgtaaataaatagttgggccttccgtattttcccactta

SEQ ID NO: 167905 - DNA, 1623 bp, Homo sapiens
  Payload ID: 13023
  Gene Symbol: KCNRG
  Gene Name: potassium channel regulator
  Uniprot ID: Q8N5I3
  ENST ID: ENST00000360473
  CDS Start-End: 241-930
agttcctcatctgttgctttttcattttgtatactgcaagttcccaggcaactcgaatttgcaaacacagccatggatacactatttaccttacagtagtttcctgggaatctaagtctggtttttgttattcttccctcccctccactgcataatcatgtataactagcaacatttatggttataggttgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggctggtatgcaatggcgtgatctcggctcaccacaacctccgcctctggggttcaagtgattctcctgcctcagcctcccgagtagctgggattacaggtatgtttctataaaacctgataaccgaaaattggccaacggaacaaatgtcctcggcttactgattgacactttattaaaggaaggctttcatttggtcagcactagaacagtatcttctgaagacaaaactgaatgctatagctttgaaaggataaaaagccctgaagtgctcatcacgaatgaaacaccaaaaccagagactatcatcataccagagcaatctcagataaagaaatgaagttgtctatcctcttttaaagagaaattgccatttttcttgtttcattacgtatttagggcatacatgttagccaaatctacactcagcctaactcttggcttcatctgctgccatgccgtctctgggcaaccaggccccaactgtgcttaagccataatgcctgctgctctctagacaactccatgtacttggtgctttggtatatgttctaccttcaatacatctttccctttctcttcttcatgaatgcttatgagccgagattgcgccactgcacactagcttgggtgacagaggaagactgtctcaaaaaaaaaaaaattgatcaaactgatggataccctaagtaccctgacttgatcattacaccttctatgcatgcaacaaaatgccacgtgtaccccataaatatgtagaaatattatatgtaaataaatagttgggccttccgtattttcccact

SEQ ID NO: 167906 - DNA, 5052 bp, Homo sapiens
  Payload ID: 13024
  Gene Symbol: KCNMB1
  Gene Name: potassium channel subfamily M regulatory beta subunit 1
  Uniprot ID: Q16558
  ENST ID: ENST00000274629
  CDS Start-End: 444-1019
agaatcatttcctatttctggcatctttgccagcccacagagacagagagaagaagaaatatttccaaatataccaggctgatctttcgtagtttctcagtcttgctgtctgttgttgtttgaaatctgtttcccacgagactctgggaagatggaggtgcagggcttgggtaacagctgccttcctcagggctgggtacctgctctccgagtctgtgtctccaggctgtgtgctcagacttgaccatgtttgggcatggaggcttgccccagatggggaccaaaagctgcttccctggagacgggcggggaggccaaacttcctgctgaagctctgtggcctcttttggggtgggggcgggggtccaggcagaaagaaactgtctgctgctcaagacccacaggacgccgggaagactaaatgatcactgcccccagtgaatatggtgaagaagctggtgatggcccagaagcggggagagacacgagccctttgcctgggtgtaaccatggtggtgtgtgccgtcatcacctactacatcctggtcacgactgtgctgcccctctaccagaaaagcgtgtggacccaggaatccaagtgccacctgattgagaccaacatcagggaccaggaggagctgaagggcaagaaggtgccccagtacccatgcctgtgggtcaacgtgtcagctgccggcaggtgggctgtgctgtaccacacggaggacactcgggaccagaaccagcagtgctcctacatcccaggcagcgtggacaattaccagacggcccgggccgacgtggagaaggtcagagccaaattccaagagcagcaggtcttctactgcttctccgcacctcgggggaacgaaaccagcgtcctattccagcgcctctacgggccccaggccctcctcttctccctcttctggcccaccttcctgctgaccggtggcctcctcattatcgccatggtgaagagcaaccagtacctgtccatcctggcggcccagaagtagagccatccatccatgccataccacttgtcagggcacaggggactggctgggcccccagggctgctccccacttgcagcacaatgccttctccacctgccctcccactcttccagtccaatccacgctgtcttctgttgcaggactaacctttgagaaatccttttgtgaagtcattgcctgctcaagaatgtacagtggctccccaatgccttggaggccataaggccagccagttctagctctctattacctgtccccactcaactgactcatacctgtttccggctgcatcactatgtgccccacagagaacgatgatcgtcacctctgtgcctgagttctccctgttgtctcaaagcggtacccatcctcccccagaagctgtccccagcgagcctcccttctttgtttgaattctctaataagagcaacagcagctcccatttctagaacacatttacagtattactattttctaggatataaagtgccatatatatttttaattccaatattaataaatgtatgccaaacaacaatcagctgcaaggaaacacatgagaactcatcaaaattttagcggtgggatggtggttaatttctgttttcttccttatcccctttttatttttgctgcttttctaaatttttgattataggaagggtgtgtttcgtttgcttttaatcagaaaagccatggtagatgccattttggaaaagttgaaagagtgtgtccccctcacagaaaaagatggaagtgggtctggggacggagttgggttccagtcagagacaggccattcagaacacacaatcttaaaaacccctctgggccgggcgcggtggctcactcctgtaatcccagcactttgggaggccgaggctggtggatcacgaggtcaggagatcaagaccatcctggctaacatggtgaaaccccgtctctactaaaaatacaaaaaattagccaggcgtggtggtgggcacctgtggtcccagctactcaggaggctgaggcaggagaatggcgtgaacccggggttcggagcttgcagtgagccgagattgtgccactgcactccagcctggtgatagaacaagactccgtctcaaaaaaaaaacaaaaaacaaaaaatgaaaaacaaccctctggaggaaaggtcatgatatagaggaggatttgttatttaaattgagggtatggactctggcactgagcctgctggggaagcctatctcagatttgaaaagggcaaaatgggaagaagccatcacctttaccattcccactccaggaagttttcctagaacgatgactgtccaagtgtggtccctgggccagcagcatcaggatcctgtggcagcttgtgagaaatgcacactctcaggcccctgtcccagccccaccacgccagaagccctgcacggggtgggggtagcaatgttctgtgttctaacaatgcgtaggggattctgtggcacacctcgagccagagaactaccggtgtaggaagtgagcgtcctgtcgcgaggattttcagagcaggtgagtgaccattcggcagggccagtcctgagctgggtgtgaagttaggctggtgtctgaagtttcttccagtgttgtgagtccaagatgcagatcttgggtttgaatcctgtctctactctgcccgatttcatctctttgattcttagttttttcatctataaaagaaggactctttctggatagttgggagggctgaaggaatgtttgacacatcataggtgtttaaaatggcaactatagttttttttgtttgttttgtgtgtgtgtttttttcttaactttcattttaagttgcagggtacacgttcaggtttgttacataggtacacttgtgtcaagggagtttgttgtgcagattatttcatcacccaggtattaagtctagtacccattattaaagaaaatgtggtacgtatacgtcatggaatattatgcagccataaaaaggaaggagatcatgtcctttgcagggacatggatggagctggaggccaaatattatccttagcaaactaacacagggacacaaaactaaatactgtatattctcacttataagtgggagctaaatgatgaaaacacatggacacaaagaggggaacaacacacactgaggcctattggagggcgggaggtaggaggagggagaggatcagggaaaaagagctattgttagtaacaagaaaaagtcggccgggcgtggtggctcacacctgtaatcccagcactttgggaggccgaggtgggcagatcacgaggtcaggagatcgagaccatcctggctaacacggtgaaaccctgtctctactaaaaaatagaaaaaatcatagccgggcgtggtggtagccgcctgtagtcccagctgctcaggaggctgaggcagaagaatggcgtgaacccgggaggcggagcttgcagtgagccgagatcgcgccacggcactccagcctgggtaacagagcaagactctgtctcaaaaaaaaaaaaaaaaaaaaaaaaaaaagaataagtcatgaatactcagaaacttccagaagttatactgacaatgttatctggcatgtatgggtgcttatttattctgtgccaggcactgtactaattagtttgccttggaaaaaaaaatgagatactcctgaacctgcctcacagatgatgagaagcaacagaggacagtggctaagtatgtggacttgggatgtgcactgtttgggttcaaattccagctgtgctgttcacaagctgggtgactttggacgaataacctttctgtgcctgtttcctcgtttgcaaaacgaaactgataatagtatctttccatagagttttggcatgaaacaaatttttatgtaaatttcctaggatagtgacatatggtaagtgctatctaagttactatgaaaaactgaggctgtaagaggtaactggccaaggccatctgtaaagtgaggggctaggactcaagcctggagctgtgtgttccagtacctggcatctcaaccacagaactcagcagagccagctgtgaagggctgagggacagagccagctgtgaagggctgaggggcagagccagctgtgaagggctgaggggcagagccagctgtgaagggctgagggacacagccactcaaagccacaggggccaggcagggagctgcgttgcatccctggaacccaggtgccctcatgcaggttggagttctgaggggaggccctggcatctgcaccagcatctgccaattccagccagggagcccagaggtatccctgtggcctccagtttcttacctggtggaccttccttccaaaggcaggcagctcatcattccctggaattttttccttctggggtcagggaagtctcaaaggtcctcatgtgagtcttttaagaaagtcttaattgtaatattgtactatagttttgcaaaatattaaatattaccattggggacattaggtagagggggcacggaatgtctctgtattatttcgtaaagcttcatgtgaatctacaattatctcaaaaatttaagttaaaaaaggaagaaaaataagaaaggaagtcccaacttggagtctgatttaaagggtctattttgtcaatggtttccatgcacctgaatttgggactaaaatacacagaaactcagaatacccaaacaatccctgcaggggaaaaggccatgttcctctagaaaaattagtatgtgaggatgcctaacccccactgtcccataaattattaatgatgaccttcatttgcttgagatagatgttctcctcctgtcaataaagactggccttctagcaaatgccacaactgtctgctgctcacagaactttatgcacgggataagcatgaaataatgggaatttaggcatgatggagttagaccctgtgcctacgtgtttttttgcaataatatctgcctgggagcagagaaccttcatcagttcttaataaaccactctgctaatga

SEQ ID NO: 167907 - DNA, 1733 bp, Homo sapiens
  Payload ID: 13024
  Gene Symbol: KCNMB1
  Gene Name: potassium channel subfamily M regulatory beta subunit 1
  Uniprot ID: Q16558
  ENST ID: ENST00000521859
  CDS Start-End: 401-793
cagagagaagaagaaatatttccaaatataccaggctgatctttcgtagtttctcagtcttgctgtctgttgttgtttgaaatctgtttcccacgagactctgggaagatggaggtgcagggcttgggtaacagctgccttcctcagggctgggtacctgctctccgagtctgtgtctccaggctgtgtgctcagacttgaccatgtttgggcatggaggcttgccccagatggggaccaaaagctgcttccctggagacgggcggggaggccaaacttcctgctgaagctctgtggcctcttttggggtgggggcgggggtccaggcagaaagaaactgtctgctgctcaagacccacaggacgccgggaagactaaatgatcactgcccccagtgaatatggtgaagaagctggtgatggcccagaagcggggagagacacgagccctttgcctgggtgtaaccatggtggtgtgtgccgtcatcacctactacatcctggtcacgactgtgctgcccctctaccagaaaagcgtgtggacccaggaatccaagtgccacctgattgagaccaacatcagggaccaggaggagctgaagggcaagaaggtgccccagtacccatgcctgtgggtcaacgtgtcagctgccggcaggtgggctgtgctgtaccacacggaggacactcgggaccagaaccagcaggtactgaactggagggatggggacacatccctttatccctgtcaggtgtgtgagcctgttcctaactgtccctgtccccgaggctgagaaagatcaacccacttgaccaggtctcacagctggaatgagactgagccagccctagctcttctgtgttggagtcacacagacctgggtttgaatctgccgctaactggctgtgtaaacataggcaggccacttagcctctcacctcctcagtttccacccttgtaaagtggaatgctaatgctgcaccttgaagagctgttatcaagtcagagacgctgtatataaagtgccacgcttgatgctgagtggatagtgggcactcaaacaaaagcagtgattagtgttagtactttcattctacaacctcagtcaaatgagggaccaggcccagggccagatcctcaaagtggaatcccggtgactccccaggaaaccagggactcagggctggagtaacctccataaacaaacatttagatggtttttccatccttgcatcccaacatcccaccctccccctccaaaacacaaaactcaccaccatatcctttcctaaagcgatcagttggcccatattctgtctctcttccttccttctttctttccttcttttttccctttcttccctccttctttcttttcttttttttcccctccctccttccctccctctctccctcccttccttccttccttccttccttccttgtttccttctttcctcctctcatttatttattcaacagccattgagcacctcctgtgtcaagcctgtaggactcaagaggagagagctcatgcatgaacagtgcctagcagggaagaattggcaccggggagaagaacagaggaagttacaggggttagaggagggggatgttttccagctgacaatgatgggggtatcagaaaggctcttggtgagattgcaccattgcactccagcctggcaacaagagtgaaactccatctcaaaaaaaaaaaaaaaaaaaagaaa

SEQ ID NO: 167908 - DNA, 2271 bp, Homo sapiens
  Payload ID: 13025
  Gene Symbol: KCNMB2
  Gene Name: potassium channel subfamily M regulatory beta subunit 2
  Uniprot ID: Q9Y691
  ENST ID: ENST00000358316
  CDS Start-End: 73-780
tctaggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaacaaaactctacagttccaacgtgctgttccattcactcttctggccaacctgtatgatggctgggggtgtggcaattgttgccatggtgaaacttacacagtacctctccctactatgtgagaggatccaacggatcaatagataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaagctgttctatatgcaaacatgatgtctttattattcaggagaataaataactgttttgtgttggttggtggttttcataatcttatttctgtactggaactagtactttcttctctcattccgccaaaacagggctcagttattcatttgccaagcttcgtggaggaatgtaggtgacatcaatgtgataaagtctgtgttctgagttgtcagatctcttgaagacaatatttttcatcacttattgtttactaaagctacagccaaaaatatttttttttcttattctaaactgagccctatagcaagtgaagggaccagatttcctaattaaaggaagttaggtacttttcttgtattttttaccatatcactgtaaagaagaggggaaacccagccagctactttttttcatcactttttattcataacttcagatttgtaaaactaatttccaaaatataagctgttttcattagccagttctataatatcttcctgtgatttatgtagaaaatgaacacaccccttttccatttaagaccctgctactgtgtgaagagatgatacttacaaggagtgtcattacctgtgagctgactgaatgttggtaggtgctccattacaatccaggaaagtctgtgttactgatatttgtgtggaaatctttatttcacttcaatttaaccattagatggtaaaattaagatgctacttgttggtaaaaattggtggactggtttcaatgggtaaatgtgttgtggcaaattaatgtgttggaatattgctctttgtgaatttgtgcttaagtcaatgaatgtgtagtatctccttctgacaagcattccctattgggattttaaagctatgtgcacagaatattagtctcttctacatgttttatttttctatttataattcccttttttgttgttatattttatacacagaatagatcttttttctaacacatatttgaactgaataacagacttaaagaaagcctttgttcacattgctatttacttttgtgtttgggggaaaatacgagggattgattttaaataaaaaacattccatctttcatttaatatcaatatcaaaagaagaagacaaacatctatctttctcatctatatttaagtacctttttgtaatgtagtatcaaagttttttaggtaatgcaaaattttacaaatcatttgtggaatgaatggtaaaactaatctgatgaaatggaaaattattctgcaatattgtaattcatagtttgacttttcataagcaaataaatccctaggatgtaatcaggacttcaaatgtgtaattaaatttttttaaaaaaaatct

SEQ ID NO: 167909 - DNA, 554 bp, Homo sapiens
  Payload ID: 13025
  Gene Symbol: KCNMB2
  Gene Name: potassium channel subfamily M regulatory beta subunit 2
  ENST ID: ENST00000437510
  CDS Start-End: 143-554
aaatccctctgtgctgttttgagtgaaacagggaaccagcgtccgccatctgacagttcctccaggtcttttaaggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaa

SEQ ID NO: 167910 - DNA, 1455 bp, Homo sapiens
  Payload ID: 13025
  Gene Symbol: KCNMB2
  Gene Name: potassium channel subfamily M regulatory beta subunit 2
  Uniprot ID: Q9Y691
  ENST ID: ENST00000452583
  CDS Start-End: 544-1251
agtgcagggcgatgtcggtctgggaaggaagactgtgagccctctctccctttttaatatgagaattcgaaagcagtggggaagtgatgttggacctatcacagcattgctaacagacagcctattacagtatttaataaaaacagaaacagcatgcctatcataggctaataaatcctacctcctgcacgctttaaaacagtatgaagcagctttaacggagctccagataactaatttcaagcatggctgtctagcgtgcctgtcactcctattgtccttccaaactctttcagacattttgagcagggagtattaaagctatgagttagaaagggttgtgacattaatggtccacaaaggctttaggcacaagaggtaatgatgattaccggtggctatttggaggactgcaccggatcgctgtcattaaaaattaagcgtggcttttgaggaagatgtgacaactaccggaggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaacaaaactctacagttccaacgtgctgttccattcactcttctggccaacctgtatgatggctgggggtgtggcaattgttgccatggtgaaacttacacagtacctctccctactatgtgagaggatccaacggatcaatagataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaagctgttctatatgcaaacatgatgtctttattattcaggagaataaataactgttttgtgttg

SEQ ID NO: 167911 - DNA, 599 bp, Homo sapiens
  Payload ID: 13025
  Gene Symbol: KCNMB2
  Gene Name: potassium channel subfamily M regulatory beta subunit 2
  ENST ID: ENST00000455865
  CDS Start-End: 300-599
gctgggcaccgttctgttttctttcttttcttaatcctatccaagtatgcagtacgctcttgggtcgtctcatgagacccaggggcatgttggaaagaactgagagaaagagcaacaaagcggcgagtggtgtgagagggcagcacgcgctgtggggcccttccagagaaatgtactgaaaaagtctacgcaatgtctgggatttgctaaacaatacctggaaagcagacaggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagc

SEQ ID NO: 167912 - DNA, 2552 bp, Homo sapiens
  Payload ID: 13025
  Gene Symbol: KCNMB2
  Gene Name: potassium channel subfamily M regulatory beta subunit 2
  Uniprot ID: Q9Y691
  ENST ID: ENST00000432997
  CDS Start-End: 353-1060
ctgtgcttcagtgggcttttcactacctttagttagttgcactaggctggttgctgtttaccttgcatggttgactgctctcttctcacattgtgtgccaggaagggcactgcaccttggtataaatgctgctgggcaccgttctgttttctttcttttcttaatcctatccaagtatgcagtacgctcttgggtcgtctcatgagacccaggggcatgttggaaagaactgagagaaagagcaacaaagcggcgagtggtgtgagagggcagcacgcgctgtgggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaacaaaactctacagttccaacgtgctgttccattcactcttctggccaacctgtatgatggctgggggtgtggcaattgttgccatggtgaaacttacacagtacctctccctactatgtgagaggatccaacggatcaatagataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaagctgttctatatgcaaacatgatgtctttattattcaggagaataaataactgttttgtgttggttggtggttttcataatcttatttctgtactggaactagtactttcttctctcattccgccaaaacagggctcagttattcatttgccaagcttcgtggaggaatgtaggtgacatcaatgtgataaagtctgtgttctgagttgtcagatctcttgaagacaatatttttcatcacttattgtttactaaagctacagccaaaaatatttttttttcttattctaaactgagccctatagcaagtgaagggaccagatttcctaattaaaggaagttaggtacttttcttgtattttttaccatatcactgtaaagaagaggggaaacccagccagctactttttttcatcactttttattcataacttcagatttgtaaaactaatttccaaaatataagctgttttcattagccagttctataatatcttcctgtgatttatgtagaaaatgaacacaccccttttccatttaagaccctgctactgtgtgaagagatgatacttacaaggagtgtcattacctgtgagctgactgaatgttggtaggtgctccattacaatccaggaaagtctgtgttactgatatttgtgtggaaatctttatttcacttcaatttaaccattagatggtaaaattaagatgctacttgttggtaaaaattggtggactggtttcaatgggtaaatgtgttgtggcaaattaatgtgttggaatattgctctttgtgaatttgtgcttaagtcaatgaatgtgtagtatctccttctgacaagcattccctattgggattttaaagctatgtgcacagaatattagtctcttctacatgttttatttttctatttataattcccttttttgttgttatattttatacacagaatagatcttttttctaacacatatttgaactgaataacagacttaaagaaagcctttgttcacattgctatttacttttgtgtttgggggaaaatacgagggattgattttaaataaaaaacattccatctttcatttaatatcaatatcaaaagaagaagacaaacatctatctttctcatctatatttaagtacctttttgtaatgtagtatcaaagttttttaggtaatgcaaaattttacaaatcatttgtggaatgaatggtaaaactaatctgatgaaatggaaaattattctgcaatattgtaattcatagtttgacttttcataagcaaataaatccctaggatgtaatcaggacttcaaatgtgtaattaaatttttttaaaaaaaatcta

SEQ ID NO: 167913 - DNA, 1563 bp, Homo sapiens
  Payload ID: 13025
  Gene Symbol: KCNMB2
  Gene Name: potassium channel subfamily M regulatory beta subunit 2
  Uniprot ID: Q9Y691
  ENST ID: ENST00000420517
  CDS Start-End: 652-1359
tatagttaaggaggatttggaaatctgatccagtgcagggcgatgtcggtctgggaaggaagactgtgagccctctctccctttttaatatgagaattcgaaagcagtggggaagtgatgttggacctatcacagcattgctaacagacagcctattacagtatttaataaaaacagaaacagcatgcctatcataggctaataaatcctacctcctgcacgctttaaaacagtatgaagcagctttaacggagctccagataactaatttcaagcatggctgtctagcgtgcctgtcactcctattgtccttccaaactctttcagacattttgagcagggagtattaaagctatgagttagaaagggttgtgacattaatggtccacaaaggctttaggcacaagaggtaatgatgattaccggtggctatttggaggactgcaccggatcgctgtcattaaaaattaagcgtggcttttgaggaagatgtgacaactaccggagggcccttccagagaaatgtactgaaaaagtctacgcaatgtctgggatttgctaaacaatacctggaaagcagacaggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaacaaaactctacagttccaacgtgctgttccattcactcttctggccaacctgtatgatggctgggggtgtggcaattgttgccatggtgaaacttacacagtacctctccctactatgtgagaggatccaacggatcaatagataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaagctgttctatatgcaaacatgatgtctttattattcaggagaataaataactgttttgtgttg

SEQ ID NO: 167914 - DNA, 608 bp, Homo sapiens
  Payload ID: 13025
  Gene Symbol: KCNMB2
  Gene Name: potassium channel subfamily M regulatory beta subunit 2
  ENST ID: ENST00000422927
  CDS Start-End: 168-248
gctcttgggtcgtctcatgagacccaggggcatgttggaaagaactgagagaaagagcaacaaagcggcgagtggtgtgagagggcagcacgcgctgtgggtctttttgccattcctccaggacatccaccataaggaaaggagaccctggaccaacattctctaagatgtttatatggaccagtggccggacctcttcatcttatagacatgatgaaaaaagtagagacggggtttcaccatgttagccaggatgatctcaatcgtctgatcttgtgatccgcccgcctcggcatccgaaagtgctgggattacaggcatgagccaccacacccggccaaatctcataaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgct

SEQ ID NO: 167915 - DNA, 2214 bp, Homo sapiens
  Payload ID: 13025
  Gene Symbol: KCNMB2
  Gene Name: potassium channel subfamily M regulatory beta subunit 2
  ENST ID: ENST00000617329
  CDS Start-End: 73-723
tctaggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaacaaaactctacagttccaacgtgctgttccattcactcttctggccaacctgtatgatggctgggggtgtggcaattgttgccatggtgaaacttacacagtacctctccctactatgtgagaggatccaacggatcaatagataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaagctgttctatatgcaaacatgatgtctttattattcaggagaataaataactgttttgtgttggttggtggttttcataatcttatttctgtactggaactagtactttcttctctcattccgccaaaacagggctcagttattcatttgccaagcttcgtggaggaatgtaggtgacatcaatgtgataaagtctgtgttctgagttgtcagatctcttgaagacaatatttttcatcacttattgtttactaaagctacagccaaaaatatttttttttcttattctaaactgagccctatagcaagtgaagggaccagatttcctaattaaaggaagttaggtacttttcttgtattttttaccatatcactgtaaagaagaggggaaacccagccagctactttttttcatcactttttattcataacttcagatttgtaaaactaatttccaaaatataagctgttttcattagccagttctataatatcttcctgtgatttatgtagaaaatgaacacaccccttttccatttaagaccctgctactgtgtgaagagatgatacttacaaggagtgtcattacctgtgagctgactgaatgttggtaggtgctccattacaatccaggaaagtctgtgttactgatatttgtgtggaaatctttatttcacttcaatttaaccattagatggtaaaattaagatgctacttgttggtaaaaattggtggactggtttcaatgggtaaatgtgttgtggcaaattaatgtgttggaatattgctctttgtgaatttgtgcttaagtcaatgaatgtgtagtatctccttctgacaagcattccctattgggattttaaagctatgtgcacagaatattagtctcttctacatgttttatttttctatttataattcccttttttgttgttatattttatacacagaatagatcttttttctaacacatatttgaactgaataacagacttaaagaaagcctttgttcacattgctatttacttttgtgtttgggggaaaatacgagggattgattttaaataaaaaacattccatctttcatttaatatcaatatcaaaagaagaagacaaacatctatctttctcatctatatttaagtacctttttgtaatgtagtatcaaagttttttaggtaatgcaaaattttacaaatcatttgtggaatgaatggtaaaactaatctgatgaaatggaaaattattctgcaatattgtaattcatagtttgacttttcataagcaaataaatccctaggatgtaatcaggacttcaaatgtgtaattaaatttttttaaaaaaaatct

SEQ ID NO: 167916 - DNA, 1485 bp, Homo sapiens
  Payload ID: 13026
  Gene Symbol: KCNMB3
  Gene Name: potassium channel subfamily M regulatory beta subunit 3
  Uniprot ID: Q9NPA1
  ENST ID: ENST00000314235
  CDS Start-End: 513-1352
tgccctgcgagaatgtatctcatcctttgctggagcaggtttgcaggcacagtggagagaggagagaagaaatgaagggacacttatgcagaaccatgagtggccagagaggaggagaaggagggtgagaggagcaaagaagccatgacaacttcataattctgagtggactgggcagtggccagaaattctggtggtggatatgctgcctttccaacaggtgaatatgaaagaataagtcaaaccctgttcaggacgctgttaattccaaatgtgaactttttgagtcattctttccatgtggaattcaaaggagaatgtaaacaaattttcaggagggacgtgcaatatccctgaaagataacaaagttcgtaacacttatttacatacaacattctctagttattgattaaacagatctctacagacttgcatgaggcaacatttcttaggcttgtttgctacaatatctttaaaaatacttgattacacatcactttagcttatttagatggacttttcaccaagctctgaactgggatttcattttgttgcattcatcctgctcacgagacacaggacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaacccccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaaggtaataattaaagtatcatattttcatgtgggaaaaaa

SEQ ID NO: 167917 - DNA, 1228 bp, Homo sapiens
  Payload ID: 13026
  Gene Symbol: KCNMB3
  Gene Name: potassium channel subfamily M regulatory beta subunit 3
  Uniprot ID: Q9NPA1
  ENST ID: ENST00000349697
  CDS Start-End: 262-1095
gcagcaaaccacgcaggtccttcttgatcatctagaactgaccgctccgccttgccaggagtctgcagaaccacgtggctagcctgcctgaagttctcacctctccaggaaggcggggggcttctaatggctgcagctgcgctgggggctgggggctcccgctgggactccacttccgtggatgtctaagcttcacctttcttgcgcccgcaggggcatgactcaggtgaaagggagccattttctcagacccctggcctcatgcagcccttcagcatccccgtgcaaatcacacttcagggcagccggaggcgccaggggaggacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaacccccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaaggtaataattaaagtatcatattttcatgtgggaaaaaa

SEQ ID NO: 167918 - DNA, 1608 bp, Homo sapiens
  Payload ID: 13026
  Gene Symbol: KCNMB3
  Gene Name: potassium channel subfamily M regulatory beta subunit 3
  Uniprot ID: Q9NPA1
  ENST ID: ENST00000392685
  CDS Start-End: 641-1468
gttcaccagacaccctgccctgcgagaatgtatctcatcctttgctggagcaggtttgcaggcacagtggagagaggagagaagaaatgaagggacacttatgcagaaccatgagtggccagagaggaggagaaggagggtgagaggagcaaagaagccatgacaacttcataattctgagtggactgggcagtggccagaaattctggtggtggatatgctgcctttccaacaggtgaatatgaaagaataagtcaaaccctgttcaggacgctgttaattccaaatgtgaactttttgagtcattctttccatgtggaattcaaaggagaatgtaaacaaattttcaggagggacgtgcaatatccctgaaagataacaaagttcgtaacacttatttacatacaacattctctagttattgattaaacagatctctacagacttgcatgaggcaacatttcttaggcttgtttgctacaatatctttaaaaatacttgattacacatcactttagcttatttagatggacttttcaccaagctctgaactgggatttcattttgttgcattcatcctgctcacgagacacaggtaggcagcaaatgagattatccctccagtccccatggattggaaatgttcccccttctttatgagctcactgcagtatctccttctccctttccccaaaggacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaacccccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaaggtaataattaaagtatcatattttcatgtgggaaaaaatttaaaa

SEQ ID NO: 167919 - DNA, 2055 bp, Homo sapiens
  Payload ID: 13026
  Gene Symbol: KCNMB3
  Gene Name: potassium channel subfamily M regulatory beta subunit 3
  Uniprot ID: Q9NPA1
  ENST ID: ENST00000392686
  CDS Start-End: 943-1716
gttcctggttctccagcaggaactgagagcaagggtcaggaggcgacaggtccaagtacagtagacactcaaagtgaaccctcagatatgaaagagccagatgaagaaaagaatgaccaacagggagaggcattggactcattgcagaagagaaagaacaagaaaaagaaaaagaagaggaaaaaatccccagtacccatagaaacccttaaagatgtttaaaaagagttaacttatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccagagaatcctaaaatgaagttggatggaaaacttgaccaagaaggcaatgatgtaaaaacagcagctgaggaggtactagctggtagagacacattagattttgaggatgtcacagttcaatcatcaggcccgagggctggtggtgaagaattagatgaaggtgttgcaaaagataatgctaaaatagctggtgccacttaaagcaatcctgaagaaccagagagcgaagatgcagatcactgcaccgtacccaaaaatgaaagtccctcacaggacattagtgatgcctgtgaagcagaaagtacagagaggtgtgggatgtcagaacatccaagtcagaccatcaggaaagctttagacagcaatagcctaaaaaaccatgacttgttggcaccaggaggagagccgggggacttcaatccagaaagcagagaagataccagaggagggaacgagaagggcaaaagcaaagaagaccgtaccatgtcctaagctgaggcaggcggcaggcgtggtgcacaggaagtctgagtgtgaggggctcttttctctccactgccaatgacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaacccccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaagcgtgatgttacagactgcagagttaaagaaaagcagacattgacagtttctgatgagcataaacagtaagtgcagtcacaggccaaacttcttgctaggaacagcaagactgggaagaggtcttaaatttagtgatactgttattattctatattctcaatatagtaacacatgcatcttgctgtgtcaaatgctttctgggccatcattaaaaggacattaaaaacgtttttcttctaatgaa

SEQ ID NO: 167920 - DNA, 1004 bp, Homo sapiens
  Payload ID: 13026
  Gene Symbol: KCNMB3
  Gene Name: potassium channel subfamily M regulatory beta subunit 3
  Uniprot ID: Q9NPA1
  ENST ID: ENST00000497599
  CDS Start-End: 293-814
acagtgcaaagagagagaagcagcttcggctgcagcaaaccacgcaggtccttcttgatcatctagaactgaccgctccgccttgccaggagtctgcagaaccacgtggctagcctgcctgaagttctcacctctccaggaaggcggggggcttctaatggctgcagctgcgctgggggctgggggctcccgctgggactccacttccgtggatgtctaagcttcacctttcttgcgcccgcaggggcatgactcaggtgaaagggagccattttctcagacccctggcctcatgcagcccttcagcatccccgtgcaaatcacacttcagggcagccggaggcgccaggggaggacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagcgtgatgttacagactgcagagttaaagaaaagcagacattgacagtttctgatgagcataaacagtaagtgcagtcacaggccaaacttcttgctaggaacagcaagactgggaagaggtcttaaatttagtgatactgttattattctatattctcaatatagtaacacatgcatcttgctgtgtcaaatgctttctgggccatcattaaaaggacattaaaaacgtttttcttctaatgaatgcagtataccacag

SEQ ID NO: 167921 - DNA, 7246 bp, Homo sapiens
  Payload ID: 13026
  Gene Symbol: KCNMB3
  Gene Name: potassium channel subfamily M regulatory beta subunit 3
  Uniprot ID: Q9NPA1
  ENST ID: ENST00000485523
  CDS Start-End: 260-1033
tacagagaggtgtgggatgtcagaacatccaagtcagaccatcaggaaagctttagacagcaatagcctaaaaaaccatgacttgttggcaccaggaggagagccgggggacttcaatccagaaagcagagaagataccagaggagggaacgagaagggcaaaagcaaagaagaccgtaccatgtcctaagctgaggcaggcggcaggcgtggtgcacaggaagtctgagtgtgaggggctcttttctctccactgccaatgacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaacccccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaaggtaataattaaagtatcatattttcatgtgggaaaaaatttaaaagcctcattttgtattctatttatttctataaatacatacaaattcaccatcttttctaatcccaatctctttccaaatgagctaaggaagcactgttttttttcctgtatagcaaaatgagttcaagatattctttgcctaatttcagctctagctagaaccagtcaatatggaaataaacaatgagggtatctaatctactgaacactgaaccatcagcctaactctatgcaatatagtcatactaaaatatttctcataaaaaagttcttaacagtttgttcactatacaaagacaaaaatctggtagaaaacttaagaaaacatggagctaacatatttattatagttttttttttttttcctttttgagatggagttttgctcgtcgcccaggctggagcacagtggcacagtcttggctcactgtgacctctgcctcctgggttcaagcaattctcttgcttcagcttcctaagtagctgggattacaggtgtgcaccaccacgcccagctaatttttgtatttttagtgtagacagggtttcaccatgttggtcaggctggtcttgagctcctgacctcaggtgatttgcccgccttggcctcccaaagtgctgggaatacaggcatgagccactgcgcttggctttagtttgttctttaccagtctagacagcagaggaaagctgctgcctagaaaattcactaagtttagagttactagtatttagccttgtcatgtaccatgtaatttttctttcagtaacatttttctagttaattaagcttttcataagctcatttcactttgtgcactttctggtgggaaaaatgggccagaaatatgaagaagctatactggattttaacattcatctcagatgatccacatcgtattaggctggtgcaaaagtaattccagtttttgctgttaacttttaatggcgaaaaaccgcaattatttttgcatcaacctaatagaaaagaagtcccacatggatagtcaacaattgtctgtactttaattaatgaatcaaccatggttattaaatgatgtcataaggctctcaacaaatgctttccaggttgattaagccgaatctatgagtggaaaagagattttggtctgattttccaaagtgcctcaaagtatctttaaaattttattatactcaaaaatcttaaattatggacagtggaatgagacatttgaagctacttttgtatgtagatgtaatcaaacaaaaaactgattctaagtcagtttaatcccttttagcaattaatttcgacacatattactaaattagctgaatacagcaatattgacttgatgagtaatgaataatcttggtgttttcctttctagtgtgcaatggtggaaagaacatgtgtctcagagtaggatttatttgactttgtaggccataattacaactttgggcaaataagctaacctgtgtaaacctttcttttctcatctataaaatggggataacccgttctttcacgcagttgttattttatggaataagcaaagtagggcaggtgaaactttagcttagcttctagcatctagtagcagtgctcaaaaatgttagatcatttatttaaaaatctgctaggttataacattcagtgagccttggtacttttcactggacagctggtatagaggctagggatagggagctgcagttcattttccatgcccctacctgagttctcttggctaaatgtgatacgcatttaaggcccagaacctgctgtttaaaaggttgtggtaaactattttgtataccaaagacttctctgtaataaagtatgtaagtacacatgaacatttgatgtgcacgcacattttaaatcatctgcacattgagattctacacttttctcaagggcacatctctattccgtttttgtaaatttgacttctacctaacaatatgcagttgctgggattttttttttccctaacaaattcaaaactgctaatttaaaatataaagcgtgtgtttcaattaccacagttttccatttagataggagctacctgattcattccagcaaagagagagattatccctggagaacaaagtcaattcaaaattatttaaaccatttggcaaataaataaaatttaagtaattatttgcttaattgctcagaaatactaagttgttaatgcctatgtgcattaatggtcaaagaaaagcccacacttaccttttgcaatgtttatgagaactgaaagcaaaaccagtttgcttctagcctaacttcatttctaggttctgatcttcaaacgacttggaaaaaagtctacttacctattgcatatacatacatacattcatacatatatgtatatacatatatttcttaaaatacaagcatataattctttatgcttaaaggaagtaaatatttaaacatacattcctttaatattcatcactttactggggtagaaaaattggcttttaaggtataatagtttcagattttcaatcaagtattcttagtcattactgaaaagaactcaaattcagctaaattttgattattagcaacaccggcttgcttttcaaaaggaatggcaaaagagaattatcacagttttttgcttatgtagtacactaaggattgtttggacacaaaaagtaatttttctttttttttttaataaacagcgtgatgttacagactgcagagttaaagaaaagcagacattgacagtttctgatgagcataaacagtaagtgcagtcacaggccaaacttcttgctaggaacagcaagactgggaagaggtcttaaatttagtgatactgttattattctatattctcaatatagtaacacatgcatcttgctgtgtcaaatgctttctgggccatcattaaaaggacattaaaaacgtttttcttctaatgaatgcagtataccacaggacttcaattcactgaatgacaaaatatagagaaataaacttgctacaattaatggggccaaaagggtggttcgaatttcttgataaagcttccaggtgaacatctgacgtgttagtagtcttcttttggtagtgccacattccccaaggtattaaaatgttatgctccaaaagggtatattcttttagattttattcaacccaattaggtctgaggactgaatcacactgaaaccattaacttcatttgaaactcaaaacatttttgaaatcagatgaaggccaagttctccaacctctcttaggaacataagttaaattgaacaagggacttttaaaaatgaaataaaaacaaaattaaataaaaatgaaataaatagataatgattttggaaattcatactagaattaagtttagtctaattatattttaatatgaaacaatgaaggttttctgcctccttgccaacctagaaaaattgacaaaaataagaatacctaaaagtatacatggttcttagcataaccacaaaattattatagtgacagattaaataaggttgcagatagattcatagactttaactggctaaaaaaatacatttaaaaaccttttctgtacttacctacatgaggaatggagtatactgttggtagaaaaatcatttacctaactactgtatacgcacaagggactaatttttttcctccactaaaactcttatatgtagttgtgtacaaattaagtcagaaaatttcctcatggctcacacctgtcactttatgctaactagcaaggctggaatattaacatacctaaaatcaagcagaagaaatggcactgcactaataaaaaggaggtgcaaaaccttaagtggaataggtgcatgaagtttatttaaagactaacatcccaacttgggaaactcctaataaattctaaactcttccgaattttagaaccttgatatttctttacaccttttataaaagatgcctcttgactagggctaagcaagcagtgtgtacacaaacagaattgtgtgcaagtatacacacaccaaatgcactaataatgaagaagagagaacaaaatgaatttcaaatgccgaattcgggaacctcctcaaactattgcctttttcaaatggctggaccaacgattaaacttcagccaagtttttttcttaaggtcttccatatcattaaaaacaaggcatgccaactctgactttataaatctaaaattcagtgatctgcacagtttctgagcttgaagtattgaattgtgactcatctatttttttttcccattttccttctgaggtagagttaccaatccaattttatcaggaccacagatattttgagctaaaccccatgatcttttcatacagtaaaaataatttttatgaaaaaagaaagcaggcttcccaggccatggcacatagatatatttacaatttttaatgtaataattaaaaatggtattgtttatattttaaaaaacagcccagctgtattattctgtcaccaagaattattaattgaggatgctgtcaatgctgaattttatagttcagccttcacaatcccatccatgatgaagagttgattctcttacggtatacaatatactctcacaactttcagccttctcttaaagacatgccccaaatgagcaggatggatataaagaatgtaattcattcaaacaactcctccctgttctgccccctcccctcacattcccctcttctcaaaaacatctgaagtatgaaagttgtctttaaatagtaaaagcaccacaatctattaacaccacatattatctttaaacttaaatattttagtgatgtcttggacatcaaaataatttcttaaggtggactcttgagtatgtgggtccagcccaggtctgcagtttgtgcagacatagaaaaaagaggaactttaaatattcagaaaaagttaacaggctagctttaaaatactgctggaaattaaatttcttcagagttggcaagcatgggctattgatcaaagtatgaattaaacggatttacatcattaagaaaaaacaaatccgtgttattgtgctgtgaaatttccatgatgcctttcaaataggctgctcacaatttttttataattccaaatcactcgatttttgatggaaaaaagaatacagatggactgtgttttacctatgtgaaagtcaccaatccatttaaaataaaatccaagagggcatatacagtctaatcaagtcatcattttcctgattaataagaactacactttacacaaaatactttatcagcagctgttttcatcaaaaaatcaagtcagtttcacagttgaaaaagttacacattaaaatattttacaattcattatatattcaccaggttcccattttctaatgggcttttaatataaagcagaatagaagggaaaatctcaaagttgattactttgacactaagttttacataggacactaagaaccacaaaaagcttaggttctattgtaaaatagcaaccaaattccattcttcttttaaaaatccaattagaaacatcttttttaaaaaaacaaattccacaataagagtaacagatttcaaattaacagtagtctaaaaatcttcaaaataaatggttttgtatagctgagaatatggtagaaagtgaaagcataattttccaacagtcatttcttactacagtgtgtttaaaattatttttattacttttagactttttctcaaaataattattcaaggaaatatttcttaagtggcccaataaaactgtagagccaatagtcagttacaccatattcaaggacaaggatagtcagctatagataggaactgtctaaaccacgagaactgatctctgatactgaagtacccagaagtggctatattatcactgacttgaaacagatcttagtcacccatgtagcatttaattcaatgtttggttctttgcctcatttctttcttaggtcacaatctatagtctttatagaatttgtctacatttcttctaatagaattaatttggttgtagtaacttttgaaaataaatgtaaatggtgaaatcg

SEQ ID NO: 167922 - DNA, 475 bp, Homo sapiens
  Payload ID: 13026
  Gene Symbol: KCNMB3
  Gene Name: potassium channel subfamily M regulatory beta subunit 3
  ENST ID: ENST00000486944
  CDS Start-End: 1-195
tgcttttacacacctaagtgccaccaagatagaaatgatttgctcaacagtgctctggacataaaagaattcttcgatcacaaaaatggaacccccttttcatgcttctacagtccagccagccaatctgaagatgtcattcttataaaaaacgtgatgttacagactgcagagttaaagaaaagcagacattgacagtttctgatgagcataaacagtaagtgcagtcacaggccaaacttcttgctaggaacagcaagactgggaagaggtcttaaatttagtgatactgttattattctatattctcaatatagtaacacatgcatcttgctgtgtcaaatgctttctgggccatcattaaaaggacattaaaaacgtttttcttctaatgaatgcagtataccacaggacttcaattcactgaatgacaaaatatagagaaataaacttgctacaattaatggggccaaaa

SEQ ID NO: 167923 - DNA, 4731 bp, Homo sapiens
  Payload ID: 13027
  Gene Symbol: KCNMB4
  Gene Name: potassium channel subfamily M regulatory beta subunit 4
  Uniprot ID: Q86W47
  ENST ID: ENST00000258111
  CDS Start-End: 460-1092
gctcgccccagctcagacactcctagccttggggcagctgccgggcgagtcagcggagtagcggccagcgggcgatggagacagagagacacccgacgagaggaggcggggtgggggaggcggggagagtgcgggggcggaggctggcagggggcgctggaagctggagcggtccgtgcgctccccgcgcccgagggtgcaggaggctctgaagcggctgctgcaccgcggggcccaggcggcggctggggggctggggggcgctgccgccgccgccgccgggggcgtcgctggcctcggcccctttgttctcgcgcgctccccctcgccgcccactcccctgctgtcgcgcggcggcggcggtggcggcggcggctcctcccgcccgaggcagtcgggctcggcgccgggggcgggagggggcggggggagcacgccagccgccgagagtggggggcgatggcgaagctccgggtggcttacgagtacacggaagccgaggacaagagcatccggctcggcttgtttctcatcatctccggcgtcgtgtcgctcttcatcttcggcttctgctggctgagtcccgcgctgcaggatctgcaagccacggaggccaattgcacggtgctgtcggtgcagcagatcggcgaggtgttcgagtgcaccttcacctgtggcgccgactgcaggggcacctcgcagtacccctgcgtccaggtctacgtgaacaactctgagtccaactctagggcgctgctgcacagcgacgagcaccagctcctgaccaaccccaagtgctcctatatccctccctgtaagagagaaaatcagaagaatttggaaagtgtcatgaattggcaacagtactggaaagatgagattggttcccagccatttacttgctattttaatcaacatcaaagaccagatgatgtgcttctgcatcgcactcatgatgagattgtcctcctgcattgcttcctctggcccctggtgacatttgtggtgggcgttctcattgtggtcctgaccatctgtgccaagagcttggcggtcaaggcggaagccatgaagaagcgcaagttctcttaaaggggaaggaggcttgtagaaagcaaagtacagaagctgtactcatcggcacgcgtccacctgcggaacctgtgtttcctggcgcaggagatggacagggccacgacagggctctgagaggctcatccctcagtggcaacagaaacaggcacaactggaagacttggaacctcaaagcttgtattccatctgctgtagcaatggctaaagggtcaagatcttagctgtatggagtaactatttcagaaaaccctataagaagttcattttctttcaaaagtaacagtatattatttgtacagtgtagtatacaaaccattatgatttatgctacttaaaaatattaaaatagagtggtctgtgttattttctatttccttttttatgcttagaacaccagggtttaaaaaaaaaaaaaaggtgaggacatctgggtctcatttgcttctgctaggttaaacttttacttgacaacaaggattcctgctgaagtctgaaccttactgtgtaaccctcagtttccactattaaagagtatcttttgacgtctgcttggaaaatgaatagtatactggtaactcagtctccagtcacctctgtgtctcttaagcaagagattctaaaagattgggaaaacatatcctccaacacctgcctttgcctaaccattatttttcaccagattacttcttaagagagggaggtgattctgaagaaggcttctatctcaaaaagcactgggcttccttattcatctgttcttgttgtttttgacggagttaaaaaagtttgtgtgcaatacaatatacatgatgtgaaggacactcttcagcttagtgaaacgctgttttcatttttttttttttttgtaggtcagaaaaaaacaacaaaatcagttcaagcatttttttttctttgtccttgccttgatgttatgagtattaaaaccaggaggattgctgccattgtgcagtttgcttagacaaacctggagatgcaacccagctcacatcattgctactgatgagctttctgtgcctttatcaaaagttgattgagaagaccatatttctttgtatctttttataaactcaaattccaagtatcaaatcgcaggtctcagtgaacatcaaacctatttactacatagaatcaaacctttgtttaggtgagatgtacatcgttagtggaggaaaaactgacaacctaatttcatttgttttcttctgatactcttcagacatgcctctattagaataaaggtaaactggaatttaaagacaagttcccctcagttatttccatggagctgtaatatgtatatatggagtgatggtttcctgacctttagtccacataccaatgttttcttttttcttttttttttttttttttgagatggtgtctcactctgttgccaggctggagtgcagtggcacgatctcggctcactacagtctccacctcctgggttcaagtcattcctctgcctcagcctcccgagtagctgggactacaggcacgcaccaccacgcctggctaatttttttgtatttttagtagagacggggtttcaccgtgttagccaggatggtctcaatctcctgaccttgtgatctgcccacttcacctcccaaagtgctgggattacaggccaatgttttcttaatcttagaatgtgaataactgaaaatcatagtctgtggaaaggtgttgaattgagtataatcttcttctgtttatttttgtgttttgttttttaacagatgggtatcttgctatgttgcccaggatggagtgcagtagctattcacaggtatgatcatagcacactgcagcctcaagctcctgggctcaagcgatccccctccctcagcctcccaagtatctggggttactggtgtgcaccaccgtgcttggctccaataattttttttctaattcaaaagttacagtttcactgtgaaaaaggccttgaacacactatttatgacatcttttgaggcagctccagtgccttgacttcaatcccagtttccggttgcagcatccttgttgtcttagcaacacagtgaactattctgaagcatagagtaacacgaaactgggagtccgagaaataatcatctctgcatcacattatgggagacgaagtctgctttatccattttatctttattcagttgtctatgattaattgattacagagtagtagattagaatagtgcatggatatacatttgtgttgaaaaaaggggaagttgatatatatcaatcttagttttcatttatcagtttgatattcatgcatttacactaaacgcttccatttatcccgaaaaagtatatgcaactgtattctgtaggttgatttttggaaaaggggagaagcacactgaattcataaggtcacatgtagtcttaaggtcttacttgcttacagccaattaaatttgaagcaccttatttatacttgttaaaggtaaaacccaaaagaacaagcagaggacattttaaggtcataaaaggtaaataagcttaccttcttaatgttttcattctctttttgtataaatcagaaaatgatctaaactgctgtaacaaagagaccccaaaatatgatggctcatgtaagataatttatttttttctcacatagcaatccagaagtggcttcatttcacaaggtattcaagggatataggagtcatctaccttgttagttctcttaatacccaagggtattgttctttccatggtcaaagctggctcaagacttcctagcctgtgaaaaaagaagaaggtggagcaagccatttcctttttaggaaattacagccatcacttctgcccaccgtccattcatgaatacttactatatagctatacctagcttcaagaaagcctgggacgtgtctctaactagatggacatgtgccctactaaaactccagggaaagggttctattactaaagctaaaaagaggggaatgaatactagagttaaagacaaaaatgatagcagccaatggcccatgccgtgataatctgctgagcaggcatgatggagatcccttgcccagcagaaagtgttccttggtgaaatcatgaatctgctatctaggagaaactcccttgtccattgtcttctgtggccactagtttgacctctaggaaagtcttgctcgtcagcttctgtggccccgtctgaaacttttgagggacatcgcagcttttgcagcccctgcttgctggtgcagacttttagacctagattgccttagagactgaaaaatatacgcttttataggccggggttttagttcatttgactgtaataaagacgtcaatgccgtttttaatgtttgactgctgacatctttcaagactcacctttcccttctcccttatgctgcacatctgggcaagctgatggaagcatgggtgcctcctcctttggccccagcaggaagttcaaatcacgcaagccctggcatgcatgcaggaagcttcaccccagcctcacactctaagacggataaaagccaaaccaattaagccgtttctcgaccctcctgggagcctgccctatctccctggaaagtctcagtatgtgagtaataaacctttttataccca

SEQ ID NO: 167924 - DNA, 472 bp, Homo sapiens
  Payload ID: 13027
  Gene Symbol: KCNMB4
  Gene Name: potassium channel subfamily M regulatory beta subunit 4
  ENST ID: ENST00000531884
  CDS Start-End: 1-134
gctcctatatccctccctgtaagagagaaaatcagaagaatttggaaagtgtcatgaattggcaacagtactggaaagatgagattggttcccagccatttacttgctattttaatcaacatcaaaggtcttgatgattacccctctttatttctgagaactcaggaagcatctccggcaggggttatccttaataggcccccgatctcagggttttaagaatcacattgggaaaaccgacagatggataaaaaataattaccacacagtaccagatgatgtgcttctgcatcgcactcatgatgagattgtcctcctgcattgcttcctctggcccctggtgacatttgtggtgggcgttctcattgtggtcctgaccatctgtgccaagagcttggcggtcaaggcggaagccatgaagaagcgcaagttctcttaaaggggaaggaggcttgtagaaagcaaagtacag

SEQ ID NO: 167925 - DNA, 1715 bp, Homo sapiens
  Payload ID: 13028
  Gene Symbol: KCTD1
  Gene Name: potassium channel tetramerization domain containing 1
  Uniprot ID: Q719H9
  ENST ID: ENST00000317932
  CDS Start-End: 112-885
tacagctcccgtcactagctttttctcctcaagcctgcactgcacaccaactgggacggagggtgcagatgaataaaggcaaatccatcaccaaaagacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgcaaaaaagaaaaaaaaaaaaggtgacagccgcagttggtgctgtgatggccgtgaagtgtcctgggccttccgaggcctctgacaaataaacaagccatgagtggtgaggacacagtctccttacagtttccattgccaacaacagccatccatatttcttttttcctttgtctttctttttcctttttttttaaaaaaacaaaacaaacaaaacaccttgaatcaagtttgtttgtatatggaggttccacgtctttctttaggcagggaccaggcaggacttcagaaaaaccctcatgagcacattgcaaagatgttagacatgaaattttaaatgtagtttgtacagaagtcacacttttttgtccacctcacagatgtgaactttactttgttttaaaactgatcagttttgccaaggggccagaattattccttgttagaattgctccagttcaagtctgctgctttcctacaatttttcaaattttataatgtattaaatacaataaactctgtttaaaaaataaggtctgtgtgaaacacacatgtgggggtgaggctggattaaagtgaaattttttctttttg

SEQ ID NO: 167926 - DNA, 2103 bp, Homo sapiens
  Payload ID: 13028
  Gene Symbol: KCTD1
  Gene Name: potassium channel tetramerization domain containing 1
  Uniprot ID: Q719H9
  ENST ID: ENST00000408011
  CDS Start-End: 561-1334
ctggaccggcgcggacttgccccagacctacggggagcgccccaggtctttaatgacagcttaaatgtggctgttggaaaagtcgaaagggatgtggctgacgtggggcgtgtttcgctcctttgcaagagtcggaaagggagttgggagccgcgcggctggccccaggcccccgcgcctcgccgccagcaagtaggtgggggagccgccgccgccgccagccccatcccgctcccaagcctcgcccgctgcgccctggccgcgggcgccgagagggtgcggggcctcgccgtgcctcctccaccctgctcattaacctgcctgctccgctccgctccgggcggccccagacacgggtttcccgcggcagcacccgcggcccgcccggcgcagccgccgccccgaccccccggctccggggggcaatgagggggcagtggaaggggcactgctcctcgggcattacttagagaaacgagaccgtcccgccctctcgccggccctccctctctcccgcccgggcccgcgcaattctccgccagagggacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgcaaaaaagaaaaaaaaaaaaggtgacagccgcagttggtgctgtgatggccgtgaagtgtcctgggccttccgaggcctctgacaaataaacaagccatgagtggtgaggacacagtctccttacagtttccattgccaacaacagccatccatatttcttttttcctttgtctttctttttcctttttttttaaaaaaacaaaacaaacaaaacaccttgaatcaagtttgtttgtatatggaggttccacgtctttctttaggcagggaccaggcaggacttcagaaaaaccctcatgagcacattgcaaagatgttagacatgaaattttaaatgtagtttgtacagaagtcacacttttttgtccacctcacagatgtgaactttactttgttttaaaactgatcagttttgccaaggggccagaattattccttgttagaattgctccagttcaagtctgctgctttcctacaatttttcaaattttataatgtattaaatacaataaactctgtttaaaaaataa

SEQ ID NO: 167927 - DNA, 1705 bp, Homo sapiens
  Payload ID: 13028
  Gene Symbol: KCTD1
  Gene Name: potassium channel tetramerization domain containing 1
  Uniprot ID: Q719H9
  ENST ID: ENST00000417602
  CDS Start-End: 102-875
cttttccagtttccgaggtgcccgcccccgcgcgcctgaggcagcgcagcccggagggcgaacgaatggcggttggcaaactttgagacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgcaaaaaagaaaaaaaaaaaaggtgacagccgcagttggtgctgtgatggccgtgaagtgtcctgggccttccgaggcctctgacaaataaacaagccatgagtggtgaggacacagtctccttacagtttccattgccaacaacagccatccatatttcttttttcctttgtctttctttttcctttttttttaaaaaaacaaaacaaacaaaacaccttgaatcaagtttgtttgtatatggaggttccacgtctttctttaggcagggaccaggcaggacttcagaaaaaccctcatgagcacattgcaaagatgttagacatgaaattttaaatgtagtttgtacagaagtcacacttttttgtccacctcacagatgtgaactttactttgttttaaaactgatcagttttgccaaggggccagaattattccttgttagaattgctccagttcaagtctgctgctttcctacaatttttcaaattttataatgtattaaatacaataaactctgtttaaaaaataaggtctgtgtgaaacacacatgtgggggtgaggctggattaaagtgaaattttttctttttg

SEQ ID NO: 167928 - DNA, 731 bp, Homo sapiens
  Payload ID: 13028
  Gene Symbol: KCTD1
  Gene Name: potassium channel tetramerization domain containing 1
  ENST ID: ENST00000580638
  CDS Start-End: 107-731
ggctgcttttccagtttccgaggtgcccgcccccgcgcgcctgaggcagcgcagcccggagggcgaacgaatggcggttggcaaactttgagacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgaga

SEQ ID NO: 167929 - DNA, 1425 bp, Homo sapiens
  Payload ID: 13028
  Gene Symbol: KCTD1
  Gene Name: potassium channel tetramerization domain containing 1
  Uniprot ID: Q719H9
  ENST ID: ENST00000580059
  CDS Start-End: 407-1180
gcccgccccgcagggctgctacgccgaggctctgaacggggcggcacggcaccactcccaccacccccccacccatccctcccaccaccaccgcccccagccgccctcgctggggaacacttacatcctccccaaagacagccaggtcgggcccgacgtgaaatccgaggctgcgcccaagcgcgccctgtacgagtctgtgttcgggtcgggggaaatctgcggccccacttcccccaaaagactttgtatccgcccctcggagcctgtggatgcggtggtggtggtttccgtgaaacacgaccccctgcctcttcttccagaagccaatgggcacagaagcaccaattctcccacaatagtttcacctgctattgtttcccccacccaggacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgcaaaaaa

SEQ ID NO: 167930 - DNA, 588 bp, Homo sapiens
  Payload ID: 13028
  Gene Symbol: KCTD1
  Gene Name: potassium channel tetramerization domain containing 1
  ENST ID: ENST00000578973
  CDS Start-End: 288-588
cttacatcctccccaaagacagccaggtcgggcccgacgtgaaatccgaggctgcgcccaagcgcgccctgtacgagtctgtgttcgggtcgggggaaatctgcggccccacttcccccaaaagactttgtatccgcccctcggagcctgtggatgcggtggtggtggtttccgtgaaacacgaccccctgcctcttcttccagaagccaatgggcacagaagcaccaattctcccacaatagtttcacctgctattgtttcccccacccaggacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccaggactacactttgttatatgaagaggcaaaatattttcagcttcagcccatgttgttggagatggaaagatggaagcaggacagagaaactggtcgattttcaaggccctgtgagtgcctcgtcgtgcgtgtggcccc

SEQ ID NO: 167931 - DNA, 1747 bp, Homo sapiens
  Payload ID: 13028
  Gene Symbol: KCTD1
  Gene Name: potassium channel tetramerization domain containing 1
  Uniprot ID: Q719H9
  ENST ID: ENST00000579973
  CDS Start-End: 141-914
ccaccacctgcctcaccagtagctgggactacagctcccgtcactagctttttctcctcaagcctgcactgcacaccaactgggacggagggtgcagatgaataaaggcaaatccatcaccaaaagacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgcaaaaaagaaaaaaaaaaaaggtgacagccgcagttggtgctgtgatggccgtgaagtgtcctgggccttccgaggcctctgacaaataaacaagccatgagtggtgaggacacagtctccttacagtttccattgccaacaacagccatccatatttcttttttcctttgtctttctttttcctttttttttaaaaaaacaaaacaaacaaaacaccttgaatcaagtttgtttgtatatggaggttccacgtctttctttaggcagggaccaggcaggacttcagaaaaaccctcatgagcacattgcaaagatgttagacatgaaattttaaatgtagtttgtacagaagtcacacttttttgtccacctcacagatgtgaactttactttgttttaaaactgatcagttttgccaaggggccagaattattccttgttagaattgctccagttcaagtctgctgctttcctacaatttttcaaattttataatgtattaaatacaataaactctgtttaaaaaataaggtctgtgtgaaacacacatgtgggggtgaggctggattaaagtgaaattttttctttttgaaa

SEQ ID NO: 167932 - DNA, 814 bp, Homo sapiens
  Payload ID: 13028
  Gene Symbol: KCTD1
  Gene Name: potassium channel tetramerization domain containing 1
  ENST ID: ENST00000580191
  CDS Start-End: 34-814
aaaaggggacttggagagagactttgtgcttcaatgtttcaggacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagc

SEQ ID NO: 167933 - DNA, 4163 bp, Homo sapiens
  Payload ID: 13029
  Gene Symbol: KCTD10
  Gene Name: potassium channel tetramerization domain containing 10
  Uniprot ID: Q9H3F6
  ENST ID: ENST00000228495
  CDS Start-End: 283-1224
acaccttgcctcccctctggcagctgaaatagcggaggtgggataaatgccctccccagccgagaaaagctggaacccactccggccggggaggctggaaagaaaactggcccctaggcgcacaacggacggcttaagacgttgccctctgcggggcggaagtggggtgcggacagcggaagttatcgctccggccccgcctccgcccccggctggcgtgagctgggtgtttcctgcctctctcagtccgggtttggagactcctgcgtcctccgacttttcatggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaaggctggatcctcattgaccgctgtgggaagcactttggtacgatactcaactaccttcgagacggggcggtgcctttacccgagagccgccgggagatcgaggagctgctagcagaagccaagtactacctagtccaaggcctggtggaagagtgccaggcggccctacaaaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgacccctgtcgttgaacaagctgtgtctaagatctctacttttcatgagaatctgagactctttggagccaggctttctcggttctcagaggaaaagtatgaatgagtgtgaagtgtatgtgagaacttttgtttgcaatatttatttttgtgggtgtcgacttcctatgtgggctttttgggtgacactcccttaagggttcagtttgacaattctgagagttgtcctgcagttggaggccaccagaggtatctgagctccctgcttcctatttcataatcctccagccccagcaggtccactcctggttcctgtgtgtttggcccgggcacaatccccactgctttgctagacgtgctttctgccatgtggctttgggcctagagcttgttgataattgcagcttgtggcagtggaaatatggctgaatgagcgtctaaatcgttgagaccagtgcaactttgggtgcaaggctttgtttagggatcaagccttttgccaccttgggctggtctttggcctggtgctcactgggaccccatatgtctgcgtaggagcagaactttccatggcagtaagtgtccagctctgtttctggttctttccccaactccagccccgtccagttgttctcctgattgacccgactccactccaggaaggccatctgaccctgtgacaggcatagctcataaactacccctccctgggatcccgctcctcttcagcctccttccccatgaagctgggctaactttctaagtcattttgcttagaaattcagtgtggcccataccctttgtcctcccagcctggcatccaggcagggacaccctcacaccaccagccccagggagcttccctgctataaacacagacccccttgtctttgcctctgatttttacacagtgtagagtggccagcagtgaacaggttgaggatgtgcgggtagatagataactttgggtctggtttgtgtctgtgttcatgtttgtttaagggatatgtgtgactgtgggtggggacgtgtgcttgtggggcacaggtggcggcccctgctggagcccggctgggcgcagcgcctatgtaggacgggtgttctcagtgacctacctcccaggctcctctgcacctgcaaaggaacaggagtgagtcgtgactgacaggggtggttgagactagactaggtagagtagttaccaggagatgtgaatgtgcgtcaggtgatggatgggtttgtcaagggaatcgttaccgttttataccaaaggtattaacatgggcagcctttgacacatgtattccaaaaacgagtttatattttcaaacggtttttacagcttagactttgtacttactgccctgcctgtgacagttgtatgccttcattttgtatccaacagcaaagtctacaataaaactttaaaacaatcatgactgaatgtcaaaatcgtgtattgggcagatgctttttaaactgtcgtgtgagaaacttttatattaggccatttggattttattaagtgctaaggaaagagggcttacaaaatgtttcgtaaatattttatactgtttaagtgttaaacaccaaccctgtctttcttttgggttgagcttttttagaaagtcgaagtgaatgttggccaggaaaatggaaaagccattgtataaatttttttttgaggcggagtcttgctctattggccaggctggagtgtagtggcaccatctccacttaccacaacttgtgcctcctgggttcaagcgattctgctgcctcagcctcccgagtagctgggattgcaggtacccatcagcccatgcccagctaattttgtatttttagtagagatggggtttcaccatgttggccaggctggtcttgaactcctgaccctgtgatccgaccaccttggcctcccaaagtgctgggattacaggtgtgagtcaccacacctggctgcatagtgttttaaatgtttgtgtgaagaatgagtttgtggaacaatttgatttgctgtggcctctatgcctaatgagctagtgtttctggcagctctctctacccaactttgcacttgtagttttgagtctttgtctctctggaatatgaacaggtttataaaacattccatggtgaacaattctgtcggctgcattatagccatgagtgaatagacagcattggctggtccaagctctgttattgagtatacaaggaactgatttttcttatgttagcactaagggcaaaaaccaatatttataatgtaagcactatccaggtaaaacactggcccaagatttggtaaagagatttcattgcaatgtaataactacagttttttacaaattggaacagctttggtgtgtcgtaatcaagggttttttttgtttgtttgtttcaaataagccatctgattgtggtgactggggcccatgtccaagacaattcctggcatattctgtcaccctcccgtggggcgatcactgtgtggggaccccattccccagttaaagtgtgtctctgtaccttacaacagcgattcaggacccaagtgtgaacaacactcagcccgccctctggagcgtgtgctgtctttagggccctacccaaagtcactgtaacagttaagtgtgtcattaacctttctgtctctttgcgccataaaaaaatgctcaaagttttagatgtagccactgtatgttgtacaaacgttggcgacatgtaaaataaaagtcataaaatgc

SEQ ID NO: 167934 - DNA, 2493 bp, Homo sapiens
  Payload ID: 13029
  Gene Symbol: KCTD10
  Gene Name: potassium channel tetramerization domain containing 10
  ENST ID: ENST00000440541
  CDS Start-End: 98-331
tcgctccggccccgcctccgcccccggctggcgtgagctgggtgtttcctgcctctctcagtccgggtttggagactcctgcgtcctccgacttttcatggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaagaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgacccctgtcgttgaacaagctgtgtctaagatctctacttttcatgagaatctgagactctttggagccaggctttctcggttctcagaggaaaagtatgaatgagtgtgaagtgtatgtgagaacttttgtttgcaatatttatttttgtgggtgtcgacttcctatgtgggctttttgggtgacactcccttaagggttcagtttgacaattctgagagttgtcctgcagttggaggccaccagaggtatctgagctccctgcttcctatttcataatcctccagccccagcaggtccactcctggttcctgtgtgtttggcccgggcacaatccccactgctttgctagacgtgctttctgccatgtggctttgggcctagagcttgttgataattgcagcttgtggcagtggaaatatggctgaatgagcgtctaaatcgttgagaccagtgcaactttgggtgcaaggctttgtttagggatcaagccttttgccaccttgggctggtctttggcctggtgctcactgggaccccatatgtctgcgtaggagcagaactttccatggcagtaagtgtccagctctgtttctggttctttccccaactccagccccgtccagttgttctcctgattgacccgactccactccaggaaggccatctgaccctgtgacaggcatagctcataaactacccctccctgggatcccgctcctcttcagcctccttccccatgaagctgggctaactttctaagtcattttgcttagaaattcagtgtggcccataccctttgtcctcccagcctggcatccaggcagggacaccctcacaccaccagccccagggagcttccctgctataaacacagacccccttgtctttgcctctgatttttacacagtgtagagtggccagcagtgaacaggttgaggatgtgcgggtagatagataactttgggtctggtttgtgtctgtgttcatgtttgtttaagggatatgtgtgactgtgggtggggacgtgtgcttgtggggcacaggtggcggcccctgctggagcccggctgggcgcagcgcctatgtaggacgggtgttctcagtgacctacctcccaggctcctctgcacctgcaaaggaacaggagtgagtcgtgactgacaggggtggttgagactagactaggtagagtagttaccaggagatgtgaatgtgcgtcaggtgatggatgggtttgtcaagggaatcgttaccgttttataccaaaggtattaacatgggcagcctttgacacatgtattccaaaaacgagtttatattttcaaacggtttttacagcttagactttgtacttactgccctgcctgtgacagttgtatgccttcattttgtatccaacagcaaagtctacaataaaactttaaaacaatcatg

SEQ ID NO: 167935 - DNA, 554 bp, Homo sapiens
  Payload ID: 13029
  Gene Symbol: KCTD10
  Gene Name: potassium channel tetramerization domain containing 10
  ENST ID: ENST00000542262
  CDS Start-End: 44-554
ctctcagtccgggtttggagactcctgcgtcctccgacttttcatggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaaggctggatcctcattgaccgctgtgggaagcactttggtacgatactcaactaccttcgagacggggcggtgcctttacccgagagccgccgggagatcgaggagctgctagcagaagccaagtactacctagtccaaggcctggtggaagagtgccaggcggccctacaaccagccgtgaagttgctctacaacagaagtaacaacaaatactcatataccagcaattctgacgacaatatgttgaaaaacattgaactgtttgataagctgtctctgcgctttaacggaaggg

SEQ ID NO: 167936 - DNA, 568 bp, Homo sapiens
  Payload ID: 13029
  Gene Symbol: KCTD10
  Gene Name: potassium channel tetramerization domain containing 10
  ENST ID: ENST00000542954
  CDS Start-End: 205-568
tgtgtacatctcaacccttcagcagagaaccccgcggtgtgaaacttgaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatca

SEQ ID NO: 167937 - DNA, 3096 bp, Homo sapiens
  Payload ID: 13029
  Gene Symbol: KCTD10
  Gene Name: potassium channel tetramerization domain containing 10
  ENST ID: ENST00000540089
  CDS Start-End: 1064-1462
gatgatgcttggctgtctgttgaaggaatgagagactctgaaagctgtttgtgcatggaaggtccttgttgtccactgggctgcattgtgggtgataaggcagactttttcagcgggacccccaactgtcagaatctgtaagccattttgggggaagcaggtggtgttcctgaagaggaatcctctactctcctcctgcctgacgggtctaggcctggccggctgcctttggggatctggaaggggaaggagctggggttgctcatcacttagtgtgatgttcacttgtccccccgttttcagaatcgcagctcagccctgtcctctaccgtgcaaaccactgcaggaagatggccctttcttctgcctgcatggggacggagatggatttggggatctttccagtgcttccgcccactggtttcagctttccccctctccttggttaacgctcacctgtgacctttctaccctcaaatttttgactttttttactggtctgctgacctcacttctcccattctttttccccttatgggtttatgcttttttttttaattcctctgcagtcatggtagtggggttttaggagcttttgattaaaacacgtttctgctgccacgtcaagggtttatttttgagtggcttcctgggctgtggaaaatgtgtcatcattgttagtacttactcagcatcctggcctatcatggtcatagccaaagagcagacttactgggaaattcaactccctgtcttcccccatctagttcactggtggtgagaatccttctctcttcccagccatgactgccccatctcccctcgccagagcctgtccagccggtcaactttaaaaatgcagtgctaggcaggcctcctaggctgaaagcatgttttgttccagcagaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgacccctgtcgttgaacaagctgtgtctaagatctctacttttcatgagaatctgagactctttggagccaggctttctcggttctcagaggaaaagtatgaatgagtgtgaagtgtatgtgagaacttttgtttgcaatatttatttttgtgggtgtcgacttcctatgtgggctttttgggtgacactcccttaagggttcagtttgacaattctgagagttgtcctgcagttggaggccaccagaggtatctgagctccctgcttcctatttcataatcctccagccccagcaggtccactcctggttcctgtgtgtttggcccgggcacaatccccactgctttgctagacgtgctttctgccatgtggctttgggcctagagcttgttgataattgcagcttgtggcagtggaaatatggctgaatgagcgtctaaatcgttgagaccagtgcaactttgggtgcaaggctttgtttagggatcaagccttttgccaccttgggctggtctttggcctggtgctcactgggaccccatatgtctgcgtaggagcagaactttccatggcagtaagtgtccagctctgtttctggttctttccccaactccagccccgtccagttgttctcctgattgacccgactccactccaggaaggccatctgaccctgtgacaggcatagctcataaactacccctccctgggatcccgctcctcttcagcctccttccccatgaagctgggctaactttctaagtcattttgcttagaaattcagtgtggcccataccctttgtcctcccagcctggcatccaggcagggacaccctcacaccaccagccccagggagcttccctgctataaacacagacccccttgtctttgcctctgatttttacacagtgtagagtggccagcagtgaacaggttgaggatgtgcgggtagatagataactttgggtctggtttgtgtctgtgttcatgtttgtttaagggatatgtgtgactgtgggtggggacgtgtgcttgtggggcacaggtggcggcccctgctggagcccggctgggcgcagcgcctatgtaggacgggtgttctcagtgacctacctcccaggctcctctgcacctgcaaaggaacaggagtgagtcgtgactgacaggggtggttgagactagactaggtagagtagttaccaggagatgtgaatgtgcgtcaggtgatggatgggtttgtcaagggaatcgttaccgttttataccaaaggtattaacatgggcagcctttgacacatgtattccaaaaacgagtttatattttcaaacggtttttacagcttagactttgtacttactgccctgcctgtgacagttgtatgccttcattttgtatccaacagcaaagtctacaataaaactttaaaacaatcatgactgaatgtc

SEQ ID NO: 167938 - DNA, 491 bp, Homo sapiens
  Payload ID: 13029
  Gene Symbol: KCTD10
  Gene Name: potassium channel tetramerization domain containing 10
  ENST ID: ENST00000540355
  CDS Start-End: 180-491
gggacccccaactgtcagaatctaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctg

SEQ ID NO: 167939 - DNA, 574 bp, Homo sapiens
  Payload ID: 13029
  Gene Symbol: KCTD10
  Gene Name: potassium channel tetramerization domain containing 10
  ENST ID: ENST00000535546
  CDS Start-End: 215-574
gatgcttggctgtctgttgaaggaatgagagactctgaaagctgtttgtgcatggaagaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccac

SEQ ID NO: 167940 - DNA, 866 bp, Homo sapiens
  Payload ID: 13029
  Gene Symbol: KCTD10
  Gene Name: potassium channel tetramerization domain containing 10
  ENST ID: ENST00000540411
  CDS Start-End: 3-866
agatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaaggctggatcctcattgaccgctgtgggaagcactttggtacgatactcaactaccttcgagacggggcggtgcctttacccgagagccgccgggagatcgaggagctgctagcagaagccaagtactacctagtccaaggcctggtggaagagtgccaggcggccctacaaaacaaagatacttatgagcctttctgcaaggtccctgtgatcacctcatccaaggaagaacaaaaacttatagcgacttcaaataagccagccgtgaagttgctctacaacagaagtaacaacaaatactcatataccagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtga

SEQ ID NO: 167941 - DNA, 564 bp, Homo sapiens
  Payload ID: 13029
  Gene Symbol: KCTD10
  Gene Name: potassium channel tetramerization domain containing 10
  ENST ID: ENST00000542858
  CDS Start-End: 39-564
agtccgggtttggagactcctgcgtcctccgacttttcatggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaaggctggatcctcattgaccgctgtgggaagcactttggtacgatactcaactaccttcgagacggggcggtgcctttacccgagagccgccgggagatcgaggagctgctagcagaagccaagtactacctagtccaaggcctggtggaagagtgccaggcggccctacaagtccctgtgatcacctcatccaaggaagaacaaaaacttatagcgacttcaaataagccagccgtgaagttgctctacaacagaagtaacaacaaatactcatataccagcaattctgacgacaatatgttgaaaaaca

SEQ ID NO: 167942 - DNA, 2940 bp, Homo sapiens
  Payload ID: 13029
  Gene Symbol: KCTD10
  Gene Name: potassium channel tetramerization domain containing 10
  ENST ID: ENST00000537165
  CDS Start-End: 39-233
agtccgggtttggagactcctgcgtcctccgacttttcatgggccctgacatggcaggtgatatccaggccactgttgggtgccatggagttggggagagttggccagaagagttggataaccttgaattgaatattgtccatgactgtcgcgttgcttctgctgttgcaagctgcctccctttactcccagtcccatttacaaaaataacgtttgtgttttaccagttatagttgtagtacccattcattatagaaaatctggaaaagctagacaattctttttcagtttcagggaatagttcaaacaagttatgtgctgtcagtgccctgcagccaaaaagcacgaggagcatacctgtagtcaagcaaagttgggtttatttccttgttgcattggggtggggaagaactgtgggacatctcagagaagggctgtgggcttgtgttgggtgatttgagagacagttcagagaagtggggctttgctctgtgttggatgctgctgggaagcagggctaattctgtgattgggtctcagtgattcctgacttgaaagcaggaagaatggaaggaggctaaacctctcattggtaaagcagcagctataactcctattagccaggataggggatctttggtcatttttgtattttggataatgtttatgtttttgtctgtgtccggacatgatgactgaatggtcctgtttttgtcttgtcgcaagggcacagagtggccttgtctgagggtgatgtgctgtgaaaaactgttgatgttcaatgggaatggtagggccagccgtgggggctaccccagattcagcaaagattctgcccacccttgcacatctccacctctacagttttacctgttcatttcagacatgtttgctctgagtacacatgtgccggataccaatctcactttccaggcctgcgtaaatcagccactgtatccatttctttgagatgtacagagagtcagccatgctatcagggagatggtagtgggatcttgctcttttgggcagcactagtctaggaggtctaattttgcaataacttggttccaaaagtttccatgtctgttgtttagtcctcagaaacaccttctccctacaggaagtgataggagtgccagctggaatcccattcaacttcataaagcttatttcatctgtgatgcagctgaaaaatgacacttagctagctattgagtggtacatggcaataaggaaatgtaaagagacctgggcagtgctttaggctgttttagggtgcagccagggtgttcatgtatacaggtgctaggcagaaaggaagtgcttataacacaagagttaggggcacccttgtgcctgcagggtcgacaggcagggtcagtgtatgaggctttttgggtgggttttgggacaaactaggggatgcatggccctctctaggggtcatccaataccccagctctgaccagttgttcccctgctagcccagttggcctctgattttaggagaagccagaagtccagatttttctgtgagctctccttagttgtccacattggaagcaaacttttaaatgctgtgtatgcgtggcccaagcaaaacacatctggaggccagattgaatccacaggctgaaagcagtcaaccaggcctgatgtcatgaccctgtatcctctccactggcaggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaaggctggatcctcattgaccgctgtgggaagcactttggtacgatactcaactaccttcgagacggggcggtgcctttacccgagagccgccgggagatcgaggagctgctagcagaagccaagtactacctagtccaaggcctggtggaagagtgccaggcggccctacaacagaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgacccctgtcgttgaacaagctgtgtctaagatctctacttttcatgagaatctgagactctttggagccaggctttctcggttctcagaggaaaagtatgaatgagtgtgaagtgtatgtg

SEQ ID NO: 167943 - DNA, 538 bp, Homo sapiens
  Payload ID: 13029
  Gene Symbol: KCTD10
  Gene Name: potassium channel tetramerization domain containing 10
  ENST ID: ENST00000541077
  CDS Start-End: 28-141
ggagactcctgcgtcctccgacttttcatggctggatcctcattgaccgctgtgggaagcactttggtacgatactcaactaccttcgagacggggcggtgcctttacccgagagccgccgggagatcgaggagctgctagcagaagccaagtactacctagtccaaggcctggtggaagagtgccaggcggccctacaaccatgactgccccatctcccctcgccagagcctgtccagccggtcaactttaaaaatgcagtgctaggcaggcctcctaggctgaaagcatgttttgttccagcagaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgtta

SEQ ID NO: 167944 - DNA, 2783 bp, Homo sapiens
  Payload ID: 13030
  Gene Symbol: KCTD11
  Gene Name: potassium channel tetramerization domain containing 11
  Uniprot ID: Q693B1
  ENST ID: ENST00000333751
  CDS Start-End: 782-1480
acttcctgggggcggagaggacctcagcggctgcggcgacacccagggaaggcggcgcggccgggtcccgaaactcctggctgtttccatcagagccctcggacactcccagcccgggctgagcacgcatcgtcgctccccggcggatacaagggggctccgccatccgctcccgtcagttcggcctccatctcctgggacccgcgccggcagccaggccaggcctctgagtggccccagagccctggctggactcgtccacggcggcagcgatctgcccggggtctcggaggccatcccttcagagtcggccctgtgctcgccaccgtcacctgctggttggattccggaaacccactgtctgaagaccacagaggggtgtcgctgaccaccccaaatcggatacgtccagacctcaagctcccttcccctctctggctgccctctgctcttttcatctcttctctcaaccttttggggatttctgtgtcctgacaccacctccccatccaccaccaaagtagccggggtgagccccaaaccttactgggtgtgctccacctgtgcctccaacccagcgaatctgacagcttcgacccaattctgcacacacccaggaagttctgccttttcttttctttcggtgtctcctgtacttcccaaaatttctcctcctcctgtgccctcttcgcccccctcctttgggggccccgtgaccctgaatgtggggggcacactatattccaccactttggagaccctgacccgcttcccagactctatgctgggggccatgtttagggccggcacccccatgccccccaacctcaattcccaaggaggcggccactacttcatcgaccgggatggcaaggccttccggcacatcctcaatttcctgaggctgggccgcctggacctgccccgtgggtacggagagacagcgctgctcagggcagaggctgacttctaccagatccggcccctcctggacgcgctgcgggaactggaggcctctcaggggacccctgcacccacagctgccctgctccacgcagatgtagatgtcagcccccgcctggtgcacttctctgctcgccggggaccccatcactatgagctgagctccgtccaggtggacaccttccgagccaaccttttctgcaccgactctgagtgtctaggtgctttgcgggcccgatttggtgtggccagtggggatagggcagaggggagcccacattttcatctggagtgggccccccgccccgtggaactccccgaggtggagtatgggagactggggctgcagccgctgtggactggggggccaggagagcggcgggaggtggtgggcaccccaagcttcctggaggaggtgctgcgggtggctctcgagcacggcttccgactagactctgtcttccccgaccccgaagacctgctcaactccaggtctctgcgctttgtccggcactgaggatgctgttctcagtttgactgtggggaggagagagaatggggtactagcacccctgaagcctctttccagctctgcttcaggagctatgagagtcgggactctcctgcacctgactggagctcagatgtgggcaggaattcccaaacctgagcccaccaaggactcacaagtggtccagaaggtctcaacctgtgctgaccctgggaggggtagggaaggttctctcagcttgttcttgcctaaggctgagcacctccagtctctccttgatttggagctcagtgtttaagggcttggaaaaggggggaacatctctttacccagactagacctagcaaaaccctggaaggatattgaggtctggggaaaagggaggactttgcattttcccaatgcggtctcttggaccatggcttctactcctgaagctgggtggcctggcctggcctgaccaatgagaggccagaacactctggaacatcggaagaggagttctttgctatgttccaagccatctactgagggaggcagaaaggccacaacccaccctaggttgatgtatgggagctaggacagtccccatggcaatggggctggagcatccctcatctggaagaatcccatactgatggcagggctggccagggggaagagggtagtatctgtgggtcctggcctttcttcatgtgtgcgtgcatatcagcccgtgtggctgactgatgtataggtccctggcatcctggttcatatctgtgttgctgactacagtgtctgtgatgtccgcatgtccaggcctgtttggggttgcctagcgactcttctggcacagggtgtgtctgtggtatacctgtgaggtggttgacaattagtagtttaatcacagggtgtgtgtgtgtgtgtgtgtgtgtgtgtttatgtgcacgcatgtatatgcatcaccacgtagccaggaggggcctgttggggtttgagtcactgggatcttcctggtgagaggtaagagaagtcactgggcttagctgggcctctgaggcctgtatggaactcttggttgctgaggcaaccatggacctgttgctaggagatagctggggaaggcccaaggccgcccagggcagagagaggagacgaagagtttgggacagtgggggaggagatgggaagggatgggatttctgggtcccagagcgggtgggatactcacgcacagcttcttcactggtggggggtggggcacacattatttctcactggtcatgatttacaagaagaaaaataaaactgcttttggaaccacaaa

SEQ ID NO: 167945 - DNA, 6225 bp, Homo sapiens
  Payload ID: 13031
  Gene Symbol: KCTD12
  Gene Name: potassium channel tetramerization domain containing 12
  Uniprot ID: Q96CX2
  ENST ID: ENST00000377474
  CDS Start-End: 243-1220
gcgggcaaggcgggcggagcgcactggaactcaagggggcgcacagcggcgcgctcgcaccgctcggctccgcgcggctctaggaggtggcggcggtggcggtggcggcggtggcggcggcggcggcggcggggcgcagggctgagcgagcgtccgggttccggggctccggggaaggcggttgcagctcctgagtgcagcgcggcttcctgccactgtcccggcccggccacctctctgtcatggctctggcggacagcacacgtggattacccaacgggggcggcggcgggggcggcagtggctcctcgtcgtcctccgcggagccaccgctcttccccgacatcgtggagctgaacgtggggggccaggtgtacgtgacccggcgctgcacggtggtgtcggtgcccgactcgctgctctggcgcatgttcacgcagcagcagccgcaggagctggcccgggacagcaaaggccgcttctttctggaccgggacggcttcctcttccgctacatcctggattacctgcgggacttgcagctcgtgctgcccgactacttccccgagcgcagccggctgcagcgcgaggccgagtacttcgagctgccagagctcgtgcgccgcctcggggcgccccagcagcccggcccggggccgccgccctcgcggcgcggggtgcacaaggagggctcgctgggtgacgagctgctgccgcttggctactcggagcccgaacagcaggagggcgcctctgccggggcgccgtcgcccacgctggagctggctagccgcagtccgtccgggggcgcggcgggcccgctgctcacgccgtcccagtcgctggacggcagccggcgctcgggctacatcaccatcggctaccgcggctcctacaccatcgggcgggacgcgcaggcggacgccaagttccggcgagtggcgcgcatcaccgtttgcggaaagacgtcgctggccaaggaggtgtttggggacaccctgaacgaaagccgggaccccgaccgtcccccggagcgctacacctcgcgctattacctcaagttcaacttcctggagcaggccttcgacaagctgtccgagtcgggcttccacatggtggcgtgcagctccacgggcacctgcgcctttgccagcagcaccgaccagagcgaggacaagatctggaccagctacaccgagtacgtcttctgcagggagtgagctccccagaccccctcgccactccagcgcccagtccttctcctgcccgagagatgattacagagcctcttgtcccacctttgtcccctggctgctgccctcccattctccccctccagtagtagctgggtgagacctgtccgcccaccttccctccactacagaacctgcagccgcaaatcctctgggctgcttcgtcttctttggacctcctgaaccgagagaacccagaggaacccccaccccacccccacctaccactccatgctttctctactccctgcctcaaaccacccctcccccagatggtacttcagtttggatctattgggggagtgtggccacagaccgggggatgattgaattgttcagaacctgattggaccgtgtccaatgtgcggaagatttccttgaaatcttctcaagctcttatgactcactgggggtttaagagatcaggattggttccactgtctggggttagtgttttacaaggtcattacacagtctttttgacctcttttgaaggtagagttttagaaggctggatggaagattctgagcctggaattaggaccccatggaggcagttcagtaactaaactaataaagttttgaaaagttacacgtaaagtagaagaatctagtgcgtgggacagtaaaggatcctttctcgtacagaataaaaggtctcagcctgtagcttaaacttatagaaagtgatccgcctgcctgcagaggcgcccttttcagctgctgctcgccagaagcccttgattccactggttgacatggcagcagttactggcaagagggagaaaggacgctgccgcctaagagtgcaaggctgctcaggtctccaagcgccgtaggaggtcacctggcagtgactgtagggagctgggtcatagtgcacgtcgtgggtattaggaaagcctgtattctttcaatgaatgtcagtaggaccttcctttagctgtaagacttggtgggcggggtggggtggggagggaggaaagggtaggaagggtgggaagggagaagcagacatagtcatttatgatttgaaagttggaagtttgtaccatctgtttgagtatatgcacatttaaaaaatatcatatagtaaatgcaaacatgccaagtattttataaagattaataacagacctactcttacctggcagtttacttaacttactgttttgagtcctaaacttagagttgttaatgcttatatataatctaaccaaagagttacccagtagggttttagtttttgaacttttattttcttgttgattataaatcctgattttggaatctattgcgcaaaagaagtttcattttggttacttagacctaagatcacttattaaaaatccttattttctccaagcccagcaaacgttgacttctgggcaaacctgaaaacctgaaaatgccactttcatgcagtttgtttgaagttaagtggaatcctttcaaatgacgagctgcagagaactcagcaccaagggctgcctatctgtagatagctgtaaaatggaatatttttaaatgaaggcaaataagtacttaaaagtgagctgagcaataaaatggtccaataataggtaaatgcaacagaaacagaaggagacctggttgccttatgcctttactcttacatggaataaattcccaatgcatatcctatgtaaaccataagtgaagggaaataaacctcgtcatgctccatgctgtgaggtgtcctttggatattctgtgatgacagagaagcctattttgttttgttttcagcatctttctctgatgtacgtttttaaggattttgtaagagctgttttcagtgtttaaattagtgctatttttccttgtttttaaaaatgaatctcgtactgtatcttactatgtccatacagatgttacaaatcgacagttttattcttagactcatgtgatccaagctgtatataccatatataaacattttacatgaatcatttagttttttaattcatttactaatgctataaaatttcctatattaccccagtaatttgcatcagctggtttatatactaaagcaacatgttttgatgagtttcttacatccttatcgaggaattgggttaggaaaaaatacataattgtaaaactgagtttgctgtattatactttttttcttgagtattagttgtattactaatcatatgttgattaactgtctacttaaagtcaaggtacctgtatttttaatccactaatttttttttagttgggaaatagatttcaggtcttttattagactaacattttttgagaagtaaaattgacttcatatacaaagcctgtaattttaggcgaaatggaagcagaaatctaggaagttgtgcttgcttgtatgttgagtttggtctcagactaagtaatgcatcagaattcatctgtttgaagcctgaaataatttaggactctgattcactgaccaaaagtcagtgttgcagagatttctctaccccgtatggtattttgttagattgttcaacaggaagcacatgattgagaacatcttgggacagaccaaaaccactgacagatggcaaggctcggcgattctgatttcccttctcaaatctgctcaactccaagagtcttgagaaactgctaaaattttgcctctgtcactcaagtcttacaaatgttatcttgtaaacctttgaggtgaactattccactgtcttgtacataggcatcttattcactgcaccctgtcacacccagcaccccccgccccgcacattatttgaaagactgggaatttaatggttagggacagtaaatctacttctttttccagggacgactgtcccctctaaagttaaagtcaatacaagaaaactgtctatttttagcctaaagtaaaggctgtgaagaaaattcattttacattgggtagacagtaaaaaacaagtaaaataacttgacatgagcacctttagatcccttcccctccatgggctttgggccacagaatgaacctttgaggcctgtaaagtggattgtaatttcctataagctgtaatagtggaggtattgtgggttcatttgagtaagccctccaaagataccattcaaataacctgggagaatgtcataaattattcagataattaacactgcatgaatctgattcagaggcatgcatttacatatgttgccctaattaccatttgatgatcataaatacaagtgaatgacattggacttttagtaacaaacttaatttttaaaaaggtgtagacaatggtggttaaaaaaaaaaaaaaaacaggtaccaggttctgtgtgtttgcaccaagtaattgacatgttttttaatacatgtggaccatgaacagtattcattctactttttcaaatgatatgctgtagaaaatattccttgaagatgtgagatttaaaaatttttccctttcaatgttgttatgtattctactggtttttgattgatagcacagtgataaatcataatactagacaaaattgtcttctctttcaaaccagagccatatatatgtctgtatatatgggacctactgcttctctgaggaaatgcataatctgttaatatcagacaaaatgagcaattggcagtgctcataatatattccaatttttattggaattttcgatggaatgttatttcaataaagccatgtaaggtgaaactttgataactttttactcttcaagttagggtaaattctgatccaatattcaattcatttgtgtactcccacatgcaaaatgctaaattacaatgcagacattaagaaaaagtattgactggaggggttgaattccttgagaatttattttatagtctaaatcacaaatactttactcaatttagtttttaaaatagtaaactgaatatttttgttgtaagcctatcagagtcaatccttcgtttggaattgttttcctgtttttccttactataaatcatttaaaaactgaattcattttcttagatggcataagtctgtctcttgagaaataagtaaaatactcctattttcagtatctgtagcacctgaaataggtctttgtatagccagaaacaagttatgttgaagttagcttttctttgtcaacagttttggacaataaaaatctgaaagtattaacacttgattttctactggggcccttcaaacttggttggaagaaattcaaccagaatatctacattagagtataatcatgtgtggtaggaagatggactagttaatcaagatttgttgtcacttaaattttttgtgatttttttccaagccagtttttttaaattctaaatgtgttttgaggtatgggtacattaattgtaatgtaaactattatacaactgtttttgcgactttataggcaggtaaattttgctattactattgaatacaaatgacaattcatttatgaccactcaaacagcgttagtaaccatttagtgacaaaggattaaaacatccatctggatgttaattttgaagatgtaaattatatgttgtttaaatttttccaggcatctgaaaaccttatctgctagacaatgtaagattcacacagagttatctgggattctgattttttaaatagtacatatcattaaaccattttctctaaatgtaagaagagcagaaaaaatcttataagattatcagatttttctaatgacacagaaatgtaagaaaaaaatccctttatattgaaaaaagatgcagtcaaagtcttttcagacatgcccaaactttgagaatttcttcaaccatctaatgctataaagatttttgttcttcctgttcacaaccagttgtataacagaaatactagctactgttttccttcctgtgtgtgaagtaatgaatcattgattatgtgacttgttatgtattcaattaaacactaaagaataaaacattcactcctttaattattcctc

SEQ ID NO: 167946 - DNA, 1685 bp, Homo sapiens
  Payload ID: 13032
  Gene Symbol: KCTD13
  Gene Name: potassium channel tetramerization domain containing 13
  Uniprot ID: Q8WZ19
  ENST ID: ENST00000308768
  CDS Start-End: 177-1166
ttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccatcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcaggttacttgatgaagaaggtggtggtcctagggcattggagaagttatgcggcttgttcaaggtcatgcagctggaagatggtggtggtaggacaggaagtccgttgggcctgattctgctgccttctagtcaacgctcctt

SEQ ID NO: 167947 - DNA, 601 bp, Homo sapiens
  Payload ID: 13032
  Gene Symbol: KCTD13
  Gene Name: potassium channel tetramerization domain containing 13
  ENST ID: ENST00000568995
  CDS Start-End: 1-423
tactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaa

SEQ ID NO: 167948 - DNA, 2528 bp, Homo sapiens
  Payload ID: 13032
  Gene Symbol: KCTD13
  Gene Name: potassium channel tetramerization domain containing 13
  Uniprot ID: Q8WZ19
  ENST ID: ENST00000568000
  CDS Start-End: 1003-1992
gggattgggtgctaggtcccacgacattagctgggattctaagacctttgctcagctgctgcggccaccactgacacgccctctgctcctcaaatacggagaacagttcagtgttcctgcctgaggatctctgcatttgccttccctctgcctggaactcttccctcacatccgcttcccagcttcagctcggcatcacctcctcagagaggccttccatccttggtgcccgggcaccactgctacccgttttggcctctgttttttttttttttttcaaaggacgttatgttgcccaggctagagtgcaacggtccgatcacggattactgcagcttccaactcctggcttcaagcgctccttctgcctcggcctcccgagtagctaggcttacaggctggggttacaggtgtgagccacagcgcccggccgctttggcctcctttaagagcttccctccgcgctttgttcgcagttctggtcacagtctgttcagtgcgcggggctgggaggcgggaaactgcccaatgcccagacctctctgtctgtttcccctcaagctcgtgaagctctctgacagcagagacccaatcacgaggtggagacttcgctttccacatcgggcagggggtcggccgcatcctcgatctggtcctggtgactcgagaccagagaggagcgcacgtcgacccgcccggggaacccgcaggccacacgccaaacctctacgggatcccccagcgaggccactgcgcatgctccatactcgcagccccgcccccattcaggggcggggccgcgcctgcgcagctgcccggcgccggcttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccatcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaagttaagttgagaaactg

SEQ ID NO: 167949 - DNA, 1773 bp, Homo sapiens
  Payload ID: 13032
  Gene Symbol: KCTD13
  Gene Name: potassium channel tetramerization domain containing 13
  ENST ID: ENST00000561540
  CDS Start-End: 204-833
gcgcctgcgcagctgcccggcgccggcttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcaggtgagggccttcggagtccccatgcctatgttcctgggagagctgcccaagcaggtattagagcagaaaaaaggagatatggggtatggcttggagagcctggctttggctggccataaccccagagaatttgaggtgccatcttctgcatccctgccgcctcaggcagcacccccaccccagcctcatgccaggacctttgcaatggttaaatagctgctctctacttcccactgttcctatgcagccagtccagctgttacactcgcacctgagtaattatctttcagcacaaccccgatctattctctctcttgcttagaaatcctaaatagctccctcatgtcactagggaaaaacatctaaatttaaattgaaatataataacctctgcgatctggccctatcctgggaggcagcattctcccatggcttccgccccccaggagctttctaattcttttttttttttaaacagtgaaattctttattcaaatgaaatctcacagaagcagggccactcccagtaaaacagggttggggattctagagaccccacctgctaggctccacttttgtggaccccttagggttctgaggagcagagcttggaaagtgaagccaggacataagggttctgtgtcacctctgtcacagctgactcagtgaccttcagtgagtccattcctacctctgggattctgtcctcgggttccgaaagacagggaagggagaaaaataagtacaaagtagtgagttttacataaagcctgttattctgttctatttttacaatgttaaaaatgtcctttcttttatgttacaatagtaagagaagattataaaagtttctttttgaatgccctttatagattaaaaggttgcctccctgaacaacttttgtctcagggaatacttactggttcttgaagcccaaaggtgtagaactcctttggacaatatccatgtttttcaaactttttgattgcctgccatagggaaaaaatgcattttagtactcattatatataactgaaataacagttctataaaaagatacttttagtgaaatgtactctgataatctttctttttaatgctgtttgggacccattacttatttcatgacccattaataaattaccacttgcatttg

SEQ ID NO: 167950 - DNA, 1860 bp, Homo sapiens
  Payload ID: 13032
  Gene Symbol: KCTD13
  Gene Name: potassium channel tetramerization domain containing 13
  ENST ID: ENST00000566842
  CDS Start-End: 1-363
aaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccaggtgaccgccggggtgcggggcactgggcgggaccctgggatgcagcacagccctgcttctgcccaaggcgagggccacggccacacggggggcctacaagaacatctgtgcctgctcgcagattcggcttcgcctcttacccctgacgctctaggaactggcagagtcctcccccttgaggtcagtactgttgtgagctccattttacagatgaggaggtcgggacaccaagaggtgaagtaacttgcctagtgtcacccagttaaaaaatggggacaccaggacccccggggaggtggcctggctcccggtccctcactggagctgctgtgctgtgctgtgctgggatttgctcagcgcatgtggcttcccttctgagacccgtttagcctggccccaggggtggaggaggctctctgttgagcaccaaagccctgggcaggagcagaggactgggaatgcatccaggcccgtcttctgggggtacagagggaggggtgccaactgcgctgaggcctcctggtcccctggtccccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccatcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaagttaagttgag

SEQ ID NO: 167951 - DNA, 264 bp, Homo sapiens
  Payload ID: 13032
  Gene Symbol: KCTD13
  Gene Name: potassium channel tetramerization domain containing 13
  ENST ID: ENST00000566413
  CDS Start-End: 1-245
caatcctcaattacctgcgggatgggtctgtgccactgccggagagtacgagagaactgggggagctgctgggcgaagcacgctactacctggtgcagggcctgattgaggactgccagctggcgctgcagtccagggcatactccggtttctccagttgttccagaaatgtgtttttacagctggttcatcaaaccagggtccagtctagatcttcacgttgcatctggttatctgcaagttaacaatggaaagcatgacttt

SEQ ID NO: 167952 - DNA, 1691 bp, Homo sapiens
  Payload ID: 13033
  Gene Symbol: KCTD14
  Gene Name: potassium channel tetramerization domain containing 14
  Uniprot ID: Q9BQ13
  ENST ID: ENST00000353172
  CDS Start-End: 46-813
aggggcgggcagccaggggcacttccgctggcccaagtgatctgcatgtggcagggctgcgcagtggagcggccagtgggcaggatgacgagccagacccctctgccccagtccccccggcccaggcggccaacgatgtctactgttgtggagctgaacgtcgggggtgagttccacaccaccaccctgggtaccctgaggaagtttccgggctcaaagctggcagagatgttctctagcttagccaaggcctccacggacgcggagggccgcttcttcatcgaccgccccagcacctatttcagacccatcctggactacctgcgcactgggcaagtgcccacacagcacatccctgaagtgtaccgtgaggctcagttctacgaaatcaagcctttggtcaagctgctggaggacatgccacagatctttggtgagcaggtgtctcggaagcagtttttgctgcaagtgccgggctacagcgagaacctggagctcatggtgcgcctggcacgtgcagaagccataacagcacggaagtccagcgtgcttgtgtgcctggtggaaactgaggagcaggatgcatattattcagaggtcctgtgttttctgcaggataagaagatgttcaagtctgttgtcaagtttgggccctggaaggcggtcctagacaacagcgacctcatgcactgcctggagatggacattaaggcccaggggtacaaggtattctccaagttctacctgacgtaccccaccaaaagaaacgaattccattttaacatttattcattcaccttcacctggtggtgatcctcaggagcagagactgttatgaattctggcgtggcttatgaaattaaaagttgccatcaaagccattttcttttaatttcacaaacatcaggcaatttccagggttggtctagagtcttgccactaaatattgatcactcgtttaaggactttccactccattgcaactgatgccactatatttgcctagcaacttgcagctacttccttttcaaagcctcatgtatctcccagacccttctcttgaagtccaataacaagaccaagtaagaatgtttcaacaatgcgttggcaagagatgtgagatgacaacaggaacatacaagatactgtgaatctagatgttctgacctaaagatgtagtctacatagccccagcttggggtccaatccatctgtccctggcatgtgccttcatgtagtaggtgctttcctgatcccctttgcgagatgctgtgggtgctaacacctcagagctgtcctcttctctagagtggaggttttcaaagtgcatcatcagcattacctgtgaacttgctggaaatacaaatcctcaggccccacctcagacctactgaatcagaatctctgggggttggcacagcattctgatttaccaaaccctccaagtgattttgatgtattctaattttgagaccatctctagaaaagaattgctacctcttgtatggaggtacaaaagactgacctcttacatcaaggaacttcctttcccagagctcctcatggaatcaagctgaagtcagtcttcttctgagagcacattcttactcagtttttttcctctgtcctacgctgcttccctcactccccttctcctaagagcactccatcaataaaccacttgcacgaga

SEQ ID NO: 167953 - DNA, 904 bp, Homo sapiens
  Payload ID: 13033
  Gene Symbol: KCTD14
  Gene Name: potassium channel tetramerization domain containing 14
  Uniprot ID: Q9BQ13
  ENST ID: ENST00000533144
  CDS Start-End: 227-904
actgagccgatctctttctttcctgctcctgcccttgcgaactgattctgtggactccttttttgctgtttctgggggaaatctcggcagatcactcgcttttctcggagtcctccccggtttactgtcagggggtgacattggcctctgttgcttgtccccaggatccctctctgacacccctgctgtgtttgctgtggggagttctgctgccaccacccattagatgtctactgttgtggagctgaacgtcgggggtgagttccacaccaccaccctgggtaccctgaggaagtttccgggctcaaagctggcagagatgttctctagcttagccaaggcctccacggacgcggagggccgcttcttcatcgaccgccccagcacctatttcagacccatcctggactacctgcgcactgggcaagtgcccacacagcacatccctgaagtgtaccgtgaggctcagttctacgaaatcaagcctttggtcaagctgctggaggacatgccacagatctttggtgagcaggtgtctcggaagcagtttttgctgcaagtgccgggctacagcgagaacctggagctcatggtgcgcctggcacgtgcagaagccataacagcacggaagtccagcgtgcttgtgtgcctggtggaaactgaggagcaggatgcatattattcagaggtcctgtgttttctgcaggataagaagatgttcaagtctgttgtcaagtttgggccctggaaggcggtcctagacaacagcgacctcatgcactgcctggagatggacattaaggcccaggggtacaaggtattctccaagttctacctgacgtaccccaccaaaagaaacgaattccattttaacatttattcattcaccttcacctggtggtga

SEQ ID NO: 167954 - DNA, 4918 bp, Homo sapiens
  Payload ID: 13034
  Gene Symbol: KCTD15
  Gene Name: potassium channel tetramerization domain containing 15
  Uniprot ID: Q96SI1
  ENST ID: ENST00000284006
  CDS Start-End: 253-957
gtaactccaggacgagaccggagcgacccgcgcagcgagcataggcggcgaagctgcgcccggcgcccgagaccggcagctgcgtggggcgggggctgcgcccgagcccgatctgccggctccgagcagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggatgttctataaaaatggcccagagtattttcaacaaagcgtgcttcatttgacacccagagtctgactttggattcgaactaaacccaggcaacaggcgaggcaggacagaggctgagtggaaaggtggtctggagccccttccctctccctgctgacctgggagtcgcaggcacccaccagctgccaagagaatccctggaccggctcttcctggatgggtccaagaattggacagctcagatggagtgagggcctattttccaacagctcttcgcagacccaagagcttggcacatttccgggttagggtggaatgggctttgcagggaagagggccccctgtgcacgcattccacagcctgtcggtcagaacttgctagttgcaggagacgggtgttacacgcagtcatcagacctcaccctcacagaggcacaaacccacatagttgtggacgcctgcagagactcaaatattgagaggacttctcctttttctctccctccagagctcccacgagctgatgcacccccaggcttcaaaccacctggaatgcacagctcagggaagctggtggatgcctagaggctgaaggacagggaactctccattattggggcaggactcagggaggacacttggggccatgtgtctggagagagggcataggttacaccctacagaataaagaagggacccaaagcctctttttgcctcccggaatcaaggccctgagggcagcaggatggtggcctgggtggggtcgtccaactaggtttgctaacctgaggggtcactgggcctggccacttctgtccctctggtggtggaacccagcacgtggttctgtagggacctttgtcagtgagcaagactgagatcgtcacaggagaaggtgcccttgctggctgccccagcaggcacccacctccctgccaggccaagccaggtgtcctcttgcagcttggccttgatgacctctgtttcttcctgggcaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttattttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctcccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaagactggaggctctgtcctgtgcagaagcagcagccagactcccgcattcgatgttgtgcagggaggtttgggggcggaacggattcctcccttggatccttcagttcccatcgaggaataacccgcagcagtggtggaggaaggtcagtggctgggtcctgagcttggtgttatttattgcatttgggtgcctgtcccctcagggcagcacagattctgaattctgattcacagtccctagccagatgggaactgggaaagagacagaaggcgtctgggtgcttttgaaccctgtctcaaatgtttgggattttctctctcactattctttggttggggatgatgtcctctttagacccccacgtaatggtatgagaaggtggcaggcagtggctcagccagccagggggcaccaagtcatgcagccagcgtgagacctgcagttcacctaagcacagaacgagatctcagtatgcctccatgtaaacagattcacataggcctccaatttcaatgagaccttttgcattttttctcaaagcccttatgttctaacccatgagaaccattttacctgccctctaagggccaccagcttcgacctgcctcaggggacagcagcacagaccagtggctccctgtccaaggccgcagagcagacgccatcccactgtacaatcgaatttgctggacaaacttgataggtttctctgcttagcaacgagcctatagttagttggcacatctgcgttttggcatctgaggctcccatctgagtggaggagaaagtgttgtgtttattagcaggaagtcttgtgaaaacagctcgctgctgtgtatgtttatggatttttctgatataacagccagcatggttaccgagtggtagagattctcgaacattctcaaactctctttttgggtaaatgattgtgctaaaaataaaatttattaataaagaaggggaaaaaggagtaactctacctgactaaatgttactctaatttatttatttctttactaattaagtaaaaccaggaagtatgattttacatcaaccagagaatttctgaatttatagggaaacactatgtccccataatgatgctataattctaatatatctagtccccataaacagtaagtacaaattatcattcctttaaagcatttttacacttcctggaatgagtatattatcagcaatcttttgtcaaatgccagccgtataaatgttacttctgctctttgtaaacctcaaaactcattattcttgattataagcaactggacagaaccatgccaaagcttccccgtttcccaccaaacccctgccagtgagtgcagagaactcgcaaagccacagcaggcggtctcagccaccgtcccgctcacaggggcccaatgccaggtcacaacactaagaatatctttcaaaaaatgtgtcttttttttttttttttttaaagctactgcttgactgttccttagaataaataaaggatattttataaattaca

SEQ ID NO: 167955 - DNA, 2555 bp, Homo sapiens
  Payload ID: 13034
  Gene Symbol: KCTD15
  Gene Name: potassium channel tetramerization domain containing 15
  Uniprot ID: Q96SI1
  ENST ID: ENST00000430256
  CDS Start-End: 409-1260
attttgtgtgtaaatgagcgtggcattctgctcacttctctctgctcgggcgggcggggctcggcggcgggcgggcagggacccgggtctcccgccgcagctggagaagcgggtcactaccgggccagtttggaaacctgtgggccctcccgaccgctatcgctgaggcccctgcaacaggcgggccagggcgcactggggctgggtgctgggtttgatgctggtgctggtggaatgaacttgtatctctcactgcacccacttttgtgcttctgacttaagcagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttattttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctcccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaa

SEQ ID NO: 167956 - DNA, 577 bp, Homo sapiens
  Payload ID: 13034
  Gene Symbol: KCTD15
  Gene Name: potassium channel tetramerization domain containing 15
  ENST ID: ENST00000590771
  CDS Start-End: 393-577
gggggcgagagagaaagtaactccaggacgagaccggagcgacccgcgcagcgagcataggcggcgaagctgcgcccggcgcccgagaccggcagctgcgtggggcgggggctgcgcccgagcccgatctgccggctccgagcttagcaaagaagcgacttcagaagaagcgatttagtgaaatcgtctcaagctgccgcagctcagccagtttaatcacccccagagagccgaacaactgcgagcgcaatgggacacaaaatcatttttggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgt

SEQ ID NO: 167957 - DNA, 1211 bp, Homo sapiens
  Payload ID: 13034
  Gene Symbol: KCTD15
  Gene Name: potassium channel tetramerization domain containing 15
  Uniprot ID: Q96SI1
  ENST ID: ENST00000588881
  CDS Start-End: 338-1189
ataggcggcgaagctgcgcccggcgcccgagaccggcagctgcgtggggcgggggctgcgcccgagcccgatctgccggctccgagcagtggtctcggaaagagggtcgtggtcccgcacggatgcgcttgttgggagaaaccttggagattcacggcaaggcgtaaagcctggggcttccaacggtgactacggcacagaggagagttactgagtgcctctggggaggagcagtagaaagggtccattggctgatctgcttgctctgtgcttcctcctggccacctggccatctcctgatgcctcggggatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctg

SEQ ID NO: 167958 - DNA, 632 bp, Homo sapiens
  Payload ID: 13034
  Gene Symbol: KCTD15
  Gene Name: potassium channel tetramerization domain containing 15
  ENST ID: ENST00000587658
  CDS Start-End: 295-632
ggggcagagaccctgggagggcggccagggagcgggggaggggcggcctggcccccggctccgctccagccccgaccgactggcagcccagtttcttcccaagtcccgcccccagccccgggcgccgcggcggcggctgctctcctctttgtaaccgaggagtcaagaaattggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgt

SEQ ID NO: 167959 - DNA, 622 bp, Homo sapiens
  Payload ID: 13034
  Gene Symbol: KCTD15
  Gene Name: potassium channel tetramerization domain containing 15
  ENST ID: ENST00000587559
  CDS Start-End: 237-622
tttttgtcgccaggcgcgggcgcgcggagctaattgcgactctaatcctctgccccgcggcgcagccgagccccgagccaggagtcgccgcgcgcgcccgttcgcgctggcagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaa

SEQ ID NO: 167960 - DNA, 534 bp, Homo sapiens
  Payload ID: 13034
  Gene Symbol: KCTD15
  Gene Name: potassium channel tetramerization domain containing 15
  ENST ID: ENST00000590906
  CDS Start-End: 303-534
atcacccccagagagccgaacaactgcgagcgcaatgggacacaaaatcatttttggtctcggaaagagggtcgtggtcccgcacggatgcgcttgttgggagaaaccttggagattcacggcaaggcgtaaagcctggggcttccaacggtgactacggcacagaggagagttactgagtgcctctggggaggagcagtagaaagggtccattggctgatctgcttgctctgtgcttcctcctggccacctggccatctcctgatgcctcggggatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtacc

SEQ ID NO: 167961 - DNA, 1625 bp, Homo sapiens
  Payload ID: 13034
  Gene Symbol: KCTD15
  Gene Name: potassium channel tetramerization domain containing 15
  Uniprot ID: Q96SI1
  ENST ID: ENST00000589786
  CDS Start-End: 250-1101
gtaactccaggacgagaccggagcgacccgcgcagcgagcataggcggcgaagctgcgcccggcgcccgagaccggcagctgcgtggggcgggggctgcgcccgagcccgatctgccggctccgagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttattttctacagtatttaaaatggatgcagccctaactgcaaaagtcagagaggctgacaaggaccaatgcttctttatctggtgctcagttctcagtcagacgtgcagcatggctgca

SEQ ID NO: 167962 - DNA, 571 bp, Homo sapiens
  Payload ID: 13034
  Gene Symbol: KCTD15
  Gene Name: potassium channel tetramerization domain containing 15
  ENST ID: ENST00000588637
  CDS Start-End: 324-571
actctaatcctctgccccgcggcgcagccgagccccgagccaggagtcgccgcgcgcgcccgttcgcgctggcagtggtctcggaaagagggtcgtggtcccgcacggatgcgcttgttgggagaaaccttggagattcacggcaaggcgtaaagcctggggcttccaacggtgactacggcacagaggagagttactgagtgcctctggggaggagcagtagaaagggtccattggctgatctgcttgctctgtgcttcctcctggccacctggccatctcctgatgcctcggggatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataag

SEQ ID NO: 167963 - DNA, 666 bp, Homo sapiens
  Payload ID: 13034
  Gene Symbol: KCTD15
  Gene Name: potassium channel tetramerization domain containing 15
  ENST ID: ENST00000590385
  CDS Start-End: 1-492
ttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggtgagggctgcacgctgccccctccccgccgcacccccggcgtccgcggagccctccaggggcagagtgagctggagggaggcgcgatccctgaaacggtgaagccccccgtgccatcctacaaaaaaggcaacaatgtgtcgatgcataatttatgtccctctcataattaaatgatggcgcctgggggatggacttaaaaaaatcgatctgtactttttttttttttttccaaaaggatgttctataaaaatggcccagagtattttcaacaaa

SEQ ID NO: 167964 - DNA, 2313 bp, Homo sapiens
  Payload ID: 13035
  Gene Symbol: KCTD16
  Gene Name: potassium channel tetramerization domain containing 16
  Uniprot ID: Q68DU8
  ENST ID: ENST00000512467
  CDS Start-End: 671-1957
agcaattgctgcttactcgtaggtaggaggaggagtttctcagacctaggtgatggaggaagactgggaggcgctaaaatgagacagacggagtcccctctcctgtccacaaactacaatgcctacaatgcctcggtgtcagcatttactgtgattcaagcactgtgctaaagtgtttttcatatgtcatgaaaagttgtgccagaaaattatggtttgaacatgggcagttttctcctaccgtcagctatatccacaagcatcacatgaagtggagatctggcagctctgtgtatttcagtcaagttccacaatgaaacctgacaataatggtaaaaaccaatacggacatctgagtaactggggaattggcctgccttgcatgtgagcttgatggaagattggatatagacgagttgattatattttatgaagtagcagctcactaccatccaccatccagggtttaaactactttttcagcatcacttcacctgtggactcttatacattttgatttcttgggggaaaaatactgggataagaggaggtcattttttaataagttagcatccttttccctttcttacaagttgatccaaaggataaggctgtgactccattggattgcacctttaaatcaaaatagcagcagcagaagaaagggacaatggctctgagtggaaactgtagtcgttattatcctcgagaacaagggtccgcagttcccaactccttccctgaggtggtagagctgaatgtcgggggtcaagtttattttactcgccattccacattgataagcatccctcattccctcctgtggaaaatgttttccccaaagagagacacggctaatgatctagccaaggactccaagggaaggtttttcattgacagagatggattcttgttccgttatattctggactatctcagggacaggcaggtggtcctgcctgatcactttccagaaaaaggaagactgaaaagggaagctgaatacttccagctcccagacttggtcaaactcctgacccccgatgaaatcaagcaaagcccagatgaattctgccacagtgactttgaagatgcctcccaaggaagcgacacaagaatctgccccccttcctccctgctccctgccgaccgcaagtggggtttcattactgtgggttacagaggatcctgcaccttgggcagagagggacaggcagatgccaagtttcggagagttccccggattttggtttgtggaaggatttccttggcaaaagaagtctttggagaaactttgaatgaaagcagagaccctgatcgagccccagaaagatacacctccagattttatctcaaattcaagcacctggaaagggcttttgatatgttgtcagagtgtggattccacatggtggcctgtaactcatcggtgacagcatctttcatcaaccaatatacagatgacaagatctggtcaagctacactgaatatgtcttctaccgtgagccttccagatggtcaccctcacactgcgattgctgctgcaagaatggcaaaggtgacaaagaaggggagagcggcacgtcttgcaatgacctctccacatctagctgcgacagccagtctgaggccagctctccccaggagacggtcatctgtggtcccgtgacacgccagaccaacatccagactctggaccgtcccatcaagaagggccctgtccagctgatccaacagtcagagatgcggcggaaaagcgacttactccggactctgacttcaggctccagggaatcgaacatgagcagcaaaaaaaaagctgttaaagaaaagctctcaattgaggaggagctggagaaatgtatccaggatttcctaaaaatcaaaattccagatcggtttcctgagagaaaacatccttggcaatctgaacttttaaggaagtatcatctataagggagggctgggggcgggaaaagaaaaaaaaaagtcattttgaaattaacctcctaaaaggaattcatattttaaaggaaaaaaatacaactaatgatgcacatttcttagaacacaatagtccattgatatactactgcctactttacctagttcaccttaacatgtaaatccacagggtagatttctttctagatgtggaagtacaagaaaatcttttttagttatttgtttgtttacttcgtcccatgtgctaactatcttatatataatgagagccagctacgtaaaagtagctgagaggccttgggagtcatttatcccaaactgggttttttctctcatccttctacctc

SEQ ID NO: 167965 - DNA, 13950 bp, Homo sapiens
  Payload ID: 13035
  Gene Symbol: KCTD16
  Gene Name: potassium channel tetramerization domain containing 16
  Uniprot ID: Q68DU8
  ENST ID: ENST00000507359
  CDS Start-End: 1092-2378
ccgaggaggacgtgactcggagctgcctccgctttctccaagccatattcctttaagatgatgtaatagtcatttccctggatggtttcttgcctgcactgctgaaacaacagcatccgaactgcactgggaactgtggaaccacccagctccgccgccagagaagccggagccccgggccccccgccggcatctctgcgctgcgttggcctctggctcgcaccggctcccacctggctgggaacatgggagtccgtttgcccttgccggcaggtggggtggctacctgggaccctagcagggcacatctctccatctttctgcttctgggctttctgaaaagcttctaagtcctggtacctcttgcaactctcttctaaggatcctttccaaagatttctttttccatttttcttttcccctggggaagctttggttgaatattttctctgctttacttcttcaacccaacctcctctcatcagggcttaactttttttgcgacttgttttaacttaagatacggaatgaacacatatgtacctacatacatacataaatacaaataggcatttatataaatgcatatatataatagttattttccaagagcacacctctctggcacttttcattgatacctcggtcgtttacctgtttgggatttgacaagatccagactcagtttggctgtggattttgattgctttacaaatggttattattatttttttcacaagaactgggtctccagcactcactaagacggacatctgagtaactggggaattggcctgccttgcatgtgagcttgatggaagattggatatagacgagttgattatattttatgaagtagcagctcactaccatccaccatccagggtttaaactactttttcagcatcacttcacctgtggactcttatacattttgatttcttgggggaaaaatactgggataagaggaggtcattttttaataagttagcatccttttccctttcttacaagttgatccaaaggataaggctgtgactccattggattgcacctttaaatcaaaatagcagcagcagaagaaagggacaatggctctgagtggaaactgtagtcgttattatcctcgagaacaagggtccgcagttcccaactccttccctgaggtggtagagctgaatgtcgggggtcaagtttattttactcgccattccacattgataagcatccctcattccctcctgtggaaaatgttttccccaaagagagacacggctaatgatctagccaaggactccaagggaaggtttttcattgacagagatggattcttgttccgttatattctggactatctcagggacaggcaggtggtcctgcctgatcactttccagaaaaaggaagactgaaaagggaagctgaatacttccagctcccagacttggtcaaactcctgacccccgatgaaatcaagcaaagcccagatgaattctgccacagtgactttgaagatgcctcccaaggaagcgacacaagaatctgccccccttcctccctgctccctgccgaccgcaagtggggtttcattactgtgggttacagaggatcctgcaccttgggcagagagggacaggcagatgccaagtttcggagagttccccggattttggtttgtggaaggatttccttggcaaaagaagtctttggagaaactttgaatgaaagcagagaccctgatcgagccccagaaagatacacctccagattttatctcaaattcaagcacctggaaagggcttttgatatgttgtcagagtgtggattccacatggtggcctgtaactcatcggtgacagcatctttcatcaaccaatatacagatgacaagatctggtcaagctacactgaatatgtcttctaccgtgagccttccagatggtcaccctcacactgcgattgctgctgcaagaatggcaaaggtgacaaagaaggggagagcggcacgtcttgcaatgacctctccacatctagctgcgacagccagtctgaggccagctctccccaggagacggtcatctgtggtcccgtgacacgccagaccaacatccagactctggaccgtcccatcaagaagggccctgtccagctgatccaacagtcagagatgcggcggaaaagcgacttactccggactctgacttcaggctccagggaatcgaacatgagcagcaaaaaaaaagctgttaaagaaaagctctcaattgaggaggagctggagaaatgtatccaggatttcctaaaaatcaaaattccagatcggtttcctgagagaaaacatccttggcaatctgaacttttaaggaagtatcatctataagggagggctgggggcgggaaaagaaaaaaaaaagtcattttgaaattaacctcctaaaaggaattcatattttaaaggaaaaaaatacaactaatgatgcacatttcttagaacacaatagtccattgatatactactgcctactttacctagttcaccttaacatgtaaatccacagggtagatttctttctagatgtggaagtacaagaaaatcttttttagttatttgtttgtttacttcgtcccatgtgctaactatcttatatataatgagagccagctacgtaaaagtagctgagaggccttgggagtcatttatcccaaactgggttttttctctcatccttctacctccctcctttgaatgagggtatggtagaaaaagatctggcccaatggcataagtttggaatttttaattttggtttttccttttgtttatggggttggggggaatggcagatttatatgacttttcactcaaatctatatgtgccagtttatattgactccgtatgcatgagtatttgtgcaacacaagcacaactaagtatgtatatacacatgacgcacacgatgccagggcctagacctcccaagggctgtgctcctgctcccagcagccctctcttagaatatttcagatggatgagcttctgactctttcttaaaattcttttgggaagatttcccagcctttcttcacaacactttctaacatcaaatgactctcatcatcaacaaattgtattccttattgtgaaattaataccctcaggctccattttactgctttgctctttgtctgcattaagagaggatgaggagagctggtcaaacattccttgtgttaaaaaaatcaaacattcatatccacaaaattttctgctaaatgactccacactcagccttctctaccctgaactgaattatcacccttttctccatgttttcagagttcttactgcccacagtttaatggtgtggcctttccacataatccacattaagttctgtgttcctgtgttgttgtggaactaaggacaacacacagtacttgaataagggtccggccttttgtttgttttagagaaagttgtattccacacacaacctaataatttcttataaaaattttaaactacaaagctacatttttacttgcttgtagccgtttttgtttgcctttgggattcgggctttggctgtgcccatgctaggatttagctgtgtcatttttatgatgtctgtaacaacccaacaaggtaactgaagctccagagttaaggtttcagatttctaaatgaaactatctttttcaattacatcctgacttgtatagacacagccaaaaagaaactgttaatagccatccgtccatgtaactctgtattttactaaggtaccaatagctctttcatagacttgtgctacaagaaggttaaaagaccagttttattttcagcattcctcatgcatttcagtggtaaccaaaaaataatttgtcaattaatagttgtgtgccaagcactcctaatttgttttattgcgtgtgtgtgcatgtgtgtatgtgtatcacaggtaataaaggcaattggatgatatctgtaggaggaaaacaatgactaatttcttccttttgaaatctttcattgatgcacatttattatgtaagatgttctgtcttgatttctgttcttagtgatgattagtatatgaatatctttctgaatttttgtaattctcgccttcacactaggatgacagactcagctaatgtttccttgtcctgaaggtttgaatggagttgaaagttttacataagtgaaaaagaaagtttatcttgggagttgagttgtcaagagaattataatttatgaatttaagtggtattcttttctgtattaatatattagcagatatttggtcttaactacaacatagctttgtttgtaaacttaccagtatgtcttgattcttttcaatgtttcttgatagcacatggcaataccatcatcctaataacagaagatcttgcaaagaatcacagagcttaatgggtcaagaagttgaatttggggaaaatatcctgaaactcactttggtcaaatgattattgtgttgtcactggaagtactgtcaaagactttgggggtctaactaaaatggccaaagttccaacttccttaaatttcagacctgactgtaatggcctcaagatagagagatacccttataagagtaaagaattaagatgatagtcaacccaatatttctactacattctttaaacaggaaattaaacactgcaaaaggagtgttcgtggcagtgttcctctgacccctgacctgtcatgagttttctctgctctgacattccttatacatccagtgaacaaagctggaatagaaaacctgtttaaaaccatcacaacagcaatatttttattctgggccacctctcgactggcactcatcccatggtaaaatattcaagtaactaagacaacagcatggcatttatttgtgtgagtgtttatatagaaatgaacatagacctggccagtaaaaggctctgaggaggcttaaagtacctagtttgagtggagttatcaagtgaggtccaggtagcctgcaacactggaaatgagttctgggtaagtgagttataagagtacatgctctagtaactctggtagtcactgtgactcgggcatgtttccctgaagttaaaatagtttttagaactttttgtttaattctgaagaaaacaatatatatggtttacttctcgaacattggttatgacaagggccataaattgctaatataaagaagttagtagtattgagtggatacaatgaatggggaatcacatgtgtagagccccaacttagattgccttctgggaaatcccgcgatactaaaatccagtgagctttgggagatcattccctaaaggtatgtgggttgtctgaagtcagaaacatatttacaaagtccttctacccactatcaaaaatgaactgatctgcattcagcaggaaaaggggaagacaggaatgtaaaactactagatcatatggtattgtgattttctttcccctgctaggaaaaaattgcactgaaatgctgacaaaaaataatgaaatgaagtggcttccaaaatatgcactgatgttatcctttgtatttataggcacagttatcttactgaaaatgcatgcatggtgaattaaaataaaagggggaacaatgcacaaataataagcgttccctttgctctttattcctttatagttgtatctattccaaccaattcattttgggggaacacatttattaagggatgttgacatggaatttttctcttttcaattagccttgttagattcagaggaatctttatccataggcacaggtgtgttgcttgttctgggccccattactgcctgcgcttctggattacttttgctttcctgggctttagattcttctctgaggatcctttgttggtgtcagacaaaacatgttacaatgagacaaaaggaaggcatgtatggtgttttgtaaaattacttgacaccagctcccacaatgggaaccaaattttgattcttatacattttcctttgctacaattccaaccttcaactttgtatctactatagtgtagatctgtgaatttgagtgctggtattttctgccactatataccatgccatggaatttgactagccttggtcttctagatgatctttactagaattaataatactctttctgtgaacttttaggaagaattctttgtcacctccacctgacataccaattttcaaaagaaaaacgaagggagtttatttttccttatggtgactctgtggcagataaatgtttttgccaatttgcatgctggtttataggtttagcatgggccatttctctctttaatgtcttggtattgttggtgtcttgcaatcttgatgccccacagtttcaatttatttattttcttttatattgtcaaaatagcacactagagaaagaaccagagtgaacattctgtatcctgagttacaatggagttacatgtcatttgtatagaactgtataatgattaatatctgcagagaaattagaccaaatgaaacctgctggaataggtttgatttatattgccttcatcattctggtttcagacgaaatggttattgctctctacccctgctgaaagaatagagtcttaaactttaataatcacagccttgtgatgcaaacacagagcttatttgtttgaaatgcctattattctcatcttgctgtatacgttggaatggagattctttttccagtgatctccattgcaaactttttaatagtgttttttaatactcagtatgcacaaaaatcatgtgtagcacttgtaaaaatgcagattccttcaacctaacttcaaagagtctgattcagaaacttgaagcagggcaaagaaatttgtattttgagctagtctccttaataattttgatgaggattgtctatagaccttactttgaaaaattctgctgtttagggaatatgcagaggccaagagttcctttactccttagaagcacttcctcattttctcttactttcttcccactacaaataagtcaaagcatgcattattcattatcttaagagaaaacacccaaagaaaaatatcctaagactagggcagaatagattttcatgaattctttgccatttcatctgctgtctgtcaaccataaccctttctccatattgtgtgtgtatgtgtatgtgtatgtgtatgggttttttcccaaaataaaagcctgcattattatagtcttagctctgggtagatgggagcatatctctgagtgagatgtattctaatgatacccaacaagaaataaaaataatgatctttcccaaggagagttgtttatttctaggcccttacttagtatgagtgggaggaaattgaaagtgatccataatttaatggtgtatatggccccaaaggtgattccattaactgcacataaaatataaccaaaatgaatatggaatgattagtgaattcagctatatttaaccaatcaaatcctgcgccattgaactgctaaatttgtccaatttgactcaatcaggactatgaagctctcagataattgaagatcctgaaccctgacattaactaaaaacttgaagccaaactgatgtgtaagaataaatgcaaaaaaaaaaaaaaaagaaaaagaaaaagaaagcaagaaagagtgaattcaaaagggtttcaatgatccaattgaccctattcatttaacagagtaactggatacataccaaattcccacgttataagaaagatgaaaatagagatcatgcttgtcatgatcatgagtgaatatttgagtaaatattgccaaaggaaagtgaaggatgtttaatgaaactgatgaacatgagcaactaattatgttaaattggccaagattaaaacaaaaatggttaaatttgattcagtttgttgccctctctcctctacttcctaagtgggatcccttttctgtcccggcttcctaatgttcaaaaaatgtttctcttgcttgtgaacaaattttgttgccaattaggtaaaaaatgttaagttcccagactgtcatccttgcattatttaggaaatttacttttaaaaggataaagaaaaatgtgcctggcctagcaactatcaagggcttgtcctggaggagggtgggggtaatcttcctgttaatcagctttgtaaaacacttatatgccaaccagagggtttattaagtctcttgtctccagcaacctcctccatcttatcagtttatttttagaattgacctttagataatttacctgcatttgcacagtgaaaaatcaacataactttatattctcttcctgctgatgtggtctccatccatcacaaatggaagcagaactgatgcttagtaaagtaatgagagttgctttcaaattacattagtgtgcatgtgtgtgtgtgcacatggccatgtgcaatttttaggtttatgtcagctcagtggataatgtgcgtgggagtgctatccgagtgcatggaaaaagcctttggttacatagtttaacagctttttagttcagcacaatagtttgtctctactgtggatgtcagtccttgagaatgttaagtaaagcttgagcttgtctcctcatgtgaaattcaaacaatactaatttctggggaaaaatcaaactcatatccatgtatatagtgaagagtagcatcttattcaaaaaaagaatgtatttttgaaagctaagatagacatagaatacatattaatcatcagtagtcttttttaattgcagccagtgatcagtggtttatctataccctttaggtgagagacagagagaaacaatttcaggaaactctccttgattcatgtgggttatgtgcatttaaggccgtggctctcaaccaggagtggttttgcataccagagatcttttggcaatgcctggagatattttttgtttcatgatttgaggggtgctactgacaattaatgggtataggccagagatgctgctaaagatcctacagtgtactggaaagccctccataacaaaaagttatccagcccacaatgtcaatagtgcttagcttgagaaactctaaattaagcatgagtttaaatttgtcaaggcatttttttttctgtaccatatacgggaagtcttccaggtcaataaataggataaaatagaaaaataaaaatcggaaccagtttaaatgtgtatagaaattatatgtatggaaattatttgaagttagacataattatctctttatgcagatgtgaaagctgagatttacagaaataggaaactttttccagggatctggtagtgatgaggaaggcctgtagtttaggtgtcttgtgttcttctacttcagtctttctgcctcagaaaaattatacttcagtgatgttgtcaatctttcaacagctaaatgtgtttgttgtgaagcactctgggatccttttcagtttacatgatcctgttaaagatgtttcccaagctgatcaacagtagaccacaaagtgctctcagaaatgaaactagtaagggggagaaagtgttttgagcaggccaatgatttcattgtctgtaactgcttatcataccctttgttactttgagttgaatattccctctctgaggatggtaaaatcttattggaaaatatgtttcctagactcacccaggggtggctcccaagtccttgtttccaaacatgtgacaagtctaagcacaagtccttgctactgagtcttattgtttagtttatatacactgactttattagaacacaatttgtgtctgaaatgatttgacatttttcttttaatgtatcataccaatatcccagggatggaattatggtagggtcattctaattccattttatacaagggaaactaaggacccagaaagtttaaatcggtcatttatttgtttgtttatgcatatatccagcaaatatttgttgggtacatactatatataggtcactgtcgtgagcattataatgtctaagcaatcaaatttggagtaaagaacttgaattaagttcattcaattcctagactaacattatttctatatgtagttctgatcagtattctagaattatggtttaaatatccagttataaataatatatattacagatttattattatgtacctgaaactctactgagtacttttcatgccttatctcatttaatcctatcataatccaatgaagtaagccctaccactatcctctctttacagatgaggtcagtgaggctcagaaagataaagtagcacataaaggctcatagctaaaaagtggcagagccagattttcctctgagtttattagactctaaaggctgctggcttaaccatctctttgtacaatctgttctctctgttctctgaactttgcctgtttctcctctctcctatgctaaacaaggtgagatcccagcctgacatccttcctaaaagtcatcagttttttttgtttgtttgtgacttgtatctgcctaggaggtaaagaaagggcagatttgctacagcttgtactttatgccacaaaaattttcaagggggcaataatgttgtagaacaagtatctggtgagtactgataccctaagaaactcaccgtgataagctagcttccacgtctggagaaaatgacacctgcaattgcttgctgtgctgcacacaggtcactagggcaagcttcaggagaagtaaaataggtgtatgagcgtgtttatatgtgtttatgcatgagtgtatctaggtatctgctattttcatcttttggcttgttaaacagtctcaggtttttattcaagacaggtcaaaagcccaaatgtgattaactgccctcagcatctcattgttactgttataagttgggaaaaagagaggcagctttagaaaagaaacttcaccgaaatacgtgcatgcatgtgtgagtgtgtgtgtgtgaggagtgtgtgtatttatgtgtgttttgtgtttatgtataaaattatgtatatatatgtacatatgtgtgtacatctatcttaatgtgtatatataaatatatatctatagctgtacatatgtatacacccataaacaaagctcatagtttaaaactttggaattttcagtttggagaacttattattattacaatttatatttggtttcctagacggtctaatatagttctaatttccaaaattctcttccactaaaagtggatatatttatttatggtgccgagaacattaacaaaatatttagatttaatatctatgaataataaaccaaaaaaagtgcatttaaggaaacaccaaacttgtaaaaactggctctcttatccaaaccatttgttggaatttcaaactacatgttttcacacttcttcattccaaaaaaaaaaaaaaaaccaaaccagaaaaaacccaaaacactaccaaatgaacagtgataatgtttaagaagaaaaagaaaaatgtaggtgtatgatagcacaaattcaatggttattgccctagtggtgcttcacttacctattggttaatttattatatcctggttaatttcactttatcactgatgagggttcctgtgtccctacatgatttatcggtggagctaattatctatttatttaaagctatagtaaataatttataatatgcatattgtaaatagatactaaaagtcatgggcacattgtaataatcacaaagttttagtctcctgcaaataacacttgaagtctgtttatacaatacccaaatagttgctcaaagaaagaacaatgtaagtcaaatacaagaaaaccttacttacctattttggcattttacagacataacaaccaaattaacgaattttggccatcttaagaatacagtaagttgtgtactcattcatagccacatgctttgcatattactggggaatgtgaaaaatatttaaagtcaacctatgcaaacagagattccctgctgctccttgggatcagtttgtatgcacacaagcccatgccttcaactgatagtcctagcacagatccctcctcccagagatctgtcaggtgtgcccacacaacagaagcacttgtaaactaattaagcacggtcactgaatccttttttcaccagccttctaaagatgttgtcttaaaaacataagaaagaaaatccatttttttaaagcaatgaaatgttctaattaggtttgaggacatttgaaggagcgattgttttttccccaaaattttggagcagaggggacgttttacatcatcctaacttcatgttcctctgtcattttattttatttatttatttttaattccaaaggagaaagttgaatcaggaaaatttgtcttaaaatatactgcttagtttagagacggacaaactaatgtatttttgtaaatcatgggtggcggatgtcaaaatctctcattaattaccctgtttttttctttaaggaaattgattcatgaataattggaaaggtattctagttaagacacacagaaacacaaacttagcggagctgcacttcagagagtcccactgtaatctgttaatagaatctgctttaaatgagtcactccttagactggcaatgacacccagcttagtctgtaaaatcaggaatctttgtgttggctgaaggaacttagtaatcttagttgaattcctcttccccatgtctttcaaaaccagagcactgggtcgaacctaacccacaaaataattcgtccaaattaaattgacttttttacataacatcagcaccaccccttacacttttaaagttaaagaccctgttgatcaggttacctggaaatttcaagtgcatctgaccagggattatcaagctccttgtgacatctgtttctgatgctgtgaatgtgatgtcaccacaaatagaggattctgaattttgctggtactaatgctgagtggtgacttattggggccttgctcatgttactttttcctgacgtcattcaagcacttgatgacttgggtcagtttgttgcacattgatgaataacaagtgacacccaatgaaattacctcttctcctttccaatgcagttcgcttgtacataaatgtaacgtcatattgtttacaggttatttttgtgcgtaattgtgatagcagatttagctcaaactttaaaggaatttgtttactgactggtgttaaaatgaatgtgcttattacagtataaacatcattaattatggactcacatgaatgcatgtctacatgtcgtcagttctcagcagctcagttattcagcaaaaagtctgcagtctgtgaatagcaaatatacataaactactgtgactctaataactctaactgtttttaccttgggatgtaacactgtagatcttcgcctgctgtatttctttcttacctatttgtttttgcgagaaaaacatgatagaaaatgctactactaattgtcccaatggaattgcacatcattttggcaatcattggttcactcagaaggcaaccgcctatagatggaacagccctgagcaacatataaatatatacatacatatctatgtatgcaatatctacactgcgaattactaccatctattctcactgccaatggaaacaaactactcttttctttggattcattgatggatataaaaaattaatttgctattaactgctttcatattctgtttagttcttatagtatggtaaatgatacaggtgcagtatcagtattgtaaaattgtatggtgaaaactacaaaagtcattctgtggatatattttaaaaggaagaacagaaactatatttcagattcttgtgtgaatataattacagaataggtaactatttttatgtgtttccataaatgactccatttcatatgcattgtaatttagcacaaatcataataaatcatttggtaaca

SEQ ID NO: 167966 - DNA, 1691 bp, Homo sapiens
  Payload ID: 13036
  Gene Symbol: KCTD17
  Gene Name: potassium channel tetramerization domain containing 17
  Uniprot ID: Q8N5Z5
  ENST ID: ENST00000402077
  CDS Start-End: 2-895
gatgcagacgccgcggccggcgatgaggatggaggccggggaggcagcgccgccggcgggggcgggcggccgcgccgcaggcggctggggcaagtgggtgcggctcaacgtggggggcacggtgttcctgaccacccggcagacgctgtgccgcgagcagaagtccttcctcagccgcctgtgccagggggaagagctgcagtcggaccgggatgagaccggggcctacctcattgaccgtgaccccacctacttcgggcccatcctgaacttcctccggcatggcaagctggtgctggacaaggacatggctgaggagggggtcctggaggaagccgagttctacaacatcggcccgctgatccgcatcatcaaagaccggatggaagagaaggactacacggtcacccaggtcccacccaagcacgtgtaccgcgtgctgcagtgccaggaggaggagctcacgcaaatggtctccaccatgtctgatggctggcgcttcgagcagctggtgaacatcggctcctcctacaactacggcagcgaggaccaggcagagttcctgtgtgtggtgtccaaggagctccacagcaccccaaacgggctgagctcagagtccagccgcaaaaccaagagcacggaggagcagctggaggagcagcagcagcaggaggaggaggtggaggaggtggaggtggaacaggtgcaggtggaggcagatgcacaggagaaaggttcccgtccgcaccctctcagacctgaggctgagcttgcagtgagggcttctcctcggcccctcgcccgcccccagagctgccatccctgctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagccca

SEQ ID NO: 167967 - DNA, 1763 bp, Homo sapiens
  Payload ID: 13036
  Gene Symbol: KCTD17
  Gene Name: potassium channel tetramerization domain containing 17
  Uniprot ID: Q8N5Z5
  ENST ID: ENST00000403888
  CDS Start-End: 2-967
gatgcagacgccgcggccggcgatgaggatggaggccggggaggcagcgccgccggcgggggcgggcggccgcgccgcaggcggctggggcaagtgggtgcggctcaacgtggggggcacggtgttcctgaccacccggcagacgctgtgccgcgagcagaagtccttcctcagccgcctgtgccagggggaagagctgcagtcggaccgggatgagaccggggcctacctcattgaccgtgaccccacctacttcgggcccatcctgaacttcctccggcatggcaagctggtgctggacaaggacatggctgaggagggggtcctggaggaagccgagttctacaacatcggcccgctgatccgcatcatcaaagaccggatggaagagaaggactacacggtcacccaggtcccacccaagcacgtgtaccgcgtgctgcagtgccaggaggaggagctcacgcaaatggtctccaccatgtctgatggctggcgcttcgagcagctggtgaacatcggctcctcctacaactacggcagcgaggaccaggcagagttcctgtgtgtggtgtccaaggagctccacagcaccccaaacgggctgagctcagagtccagccgcaaaaccaagagcacggaggagcagctggaggagcagcagcagcaggaggaggaggtggaggaggtggaggtggaacaggtgcaggtggaggcagatgcacaggagaaagcccagtcatctcaggatcccgctaaccttttctccctcccaccactgcctcctcctccgcttcccgctggaggttcccgtccgcaccctctcagacctgaggctgagcttgcagtgagggcttctcctcggcccctcgcccgcccccagagctgccatccctgctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagccca

SEQ ID NO: 167968 - DNA, 559 bp, Homo sapiens
  Payload ID: 13036
  Gene Symbol: KCTD17
  Gene Name: potassium channel tetramerization domain containing 17
  ENST ID: ENST00000431531
  CDS Start-End: 371-559
attagaagctctccagccgccccggatcggggcctctccttctcctttggggctgtggacagggagagacctgggacctttcctccctcccaaaggggactcctgctctggggaaggagtcgacgaggctacttctcccgctctttgggatgtgggtggcggaggggtgcagggagctagctggatggaggagccctggggcgccttctgagcgggctgaatctagaaggagcgttggcccagcgggcactatttctgagcacccaccctgactctgctgcacactgcctgccgcgaccttgagtcggacccttccctgcactgcgctcagcctccttcctcatctgtaacacgaagggctggtctgaagatgacctctaaggtctcctgtcccccatccgtgaccctccgatgctgtggcctttggcaagtcgcctcacctctcaatgtctccgatctctctgatgagaccggggcctacctcattgaccgtgaccccacctacttcgggcccatcctgaacttcctccggcatggcaagctggtgctggacaaggac

SEQ ID NO: 167969 - DNA, 451 bp, Homo sapiens
  Payload ID: 13036
  Gene Symbol: KCTD17
  Gene Name: potassium channel tetramerization domain containing 17
  ENST ID: ENST00000421900
  CDS Start-End: 1-314
ggggcacggtgttcctgaccacccggcagacgctgtgccgcgagcagaagtccttcctcagccgcctgtgccagggggaagagctgcagtcggaccgggatgagaccggggcctacctcattgaccgtgaccccacctacttcgggcccatcctgaacttcctccggcatggcaagctggtgctggacaaggacatggctgaggagggggtcctggaggaagccgagttctacaacatcggcccgctgatccgcatcatcaaagaccggatggaagagaaggactacacggtcacccaggtgccctctatgtgacccttctgcccacaggtcccacccaagcacgtgtaccgcgtgctgcagtgccaggaggaggagctcacgcaaatggtctccaccatgtctgatggctggcgcttcgagcagctggtgaacatcggctcctcctacaa

SEQ ID NO: 167970 - DNA, 1438 bp, Homo sapiens
  Payload ID: 13036
  Gene Symbol: KCTD17
  Gene Name: potassium channel tetramerization domain containing 17
  ENST ID: ENST00000456470
  CDS Start-End: 1-542
ggcagacgctgtgccgcgagcagaagtccttcctcagccgcctgtgccagggggaagagctgcagtcggaccgggatgagaccggggcctacctcattgaccgtgaccccacctacttcgggcccatcctgaacttcctccggcatggcaagctggtgctggacaaggacatggctgaggagggggtcctggaggaagccgagttctacaacatcggcccgctgatccgcatcatcaaagaccggatggaagagaaggactacacggtcacccaggtcccacccaagcacgtgtaccgcgtgctgcagtgccaggaggaggagctcacgcaaatggtctccaccatgtctgatggctggcgcttcgagcagctggtgaacatcggctcctcctacaactacggcagcgaggaccaggcagagttcctgtgtgtggtgtccaaggagctccacagcaccccaaacgggctgagctcagagtccagccgcaaaaccaaggttcccgtccgcaccctctcagacctgaggctgagcttgcagtgagggcttctcctcggcccctcgcccgcccccagagctgccatccctgctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaac

SEQ ID NO: 167971 - DNA, 1502 bp, Homo sapiens
  Payload ID: 13036
  Gene Symbol: KCTD17
  Gene Name: potassium channel tetramerization domain containing 17
  ENST ID: ENST00000610767
  CDS Start-End: 5-667
gaggatgcagacgccgcggccggcgatgaggatggaggccggggaggcagcgccgccggcgggggcgggcggccgcgccgcaggcggctggggcaagtgggtgcggctcaacgtggggggcacggtgttcctgaccacccggcagacgctgtgccgcgagcagaagtccttcctcagccgcctgtgccagggggaagagctgcagtcggaccgggatgagaccggggcctacctcattgaccgtgaccccacctacttcgggcccatcctgaacttcctccggcatggcaagctggtgctggacaaggacatggctgaggagggggtcctggaggaagccgagttctacaacatcggcccgctgatccgcatcatcaaagaccggatggaagagaaggactacacggtcacccaggtcccacccaagcacgtgtaccgcgtgctgcagtgccaggaggaggagctcacgcaaatggtctccaccatgtctgatggctggcgcttcgagcagctggtgaacatcggctcctcctacaactacggcagcgaggaccaggcagagttcctgtgtgtggtgtccaaggagctccacagcaccccaaacgggctgagctcagagtccagccgcaaaaccaagctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagccc

SEQ ID NO: 167972 - DNA, 2940 bp, Homo sapiens
  Payload ID: 13037
  Gene Symbol: KCTD18
  Gene Name: potassium channel tetramerization domain containing 18
  Uniprot ID: Q6PI47
  ENST ID: ENST00000359878
  CDS Start-End: 512-1792
cgcgtccgccccgcggcgtccggcggccgcgccgagggtctggcgggccgcaggtcagtctgggaagctgccgacccgccccacccccccggtgcggaagagccgggcgcgggatgggccgcgggcccggaaggcggcggggcgccctgaggaagggcacgggccgcgctggtaacgcgcgcgccccgggctgcaggctcgggcttcgggccgatttggggtctccaggccgcggaagaccgtggcggggctttctggctccccagctcctcccggctcttcccgcttcggaagaggagtgtgagccccttgagcgatgtttttcaaagtggggttcgcgggcagatcccgacccctcctcagactttctgaggaactgtgtgctgtggccggagtgtcttcgttttcccaagcgtccctgatggttttgatgcagagggagaccaagacatcattgttttgaagtttctgaaagtgttgggcggcaaaaattcaggtgcctgggggagaaatggaaggccacaaggcagaagaagaggtgctagatgttctccgactgaacgtgggtggctgtatttacacagcccggcgggagtccttgtgccgcttcaaggactccatgttggcatctatgttcagtggtcgctttcctctaaaaacagatgagtcaggggcttgtgttattgaccgtgatggacgtctatttaaataccttttggattaccttcatggagaagttcagattcccacagatgagcaaacccgcatcgccctacaggaagaggctgattactttggcatcccttatccatacagcctgtctgaccatttggccaatgaaatggagacatattctttaaggtcaaatatagaacttaaaaaggctttaacagacttctgtgattcatatggcttagtctgcaataaaccaacagtttgggttctccactatcttaacacatctggtgcaagctgtgagagtagaattattggtgtatatgccacaaaaactgatggaacagacgctattgaaaagcagctgggaggaagaattcacagcaaaggcatttttaaaagagaggcgggaaataatgttcagtacatttggagctattattcagtagcagagttgaagaaaatgatggatgcctttgatgcttgggaaggaaaaggtgttagctactggcgggtgcctcatgagctgatagagtgttggactctagaagaacggcctttacttggaagcctgcgtcacatggctccaattcgaaagaggcgactgataacgttcaatgaagcggacgaaagtgtgaactataagactggtcctaagccagttagatttttgggcccttccacaagtacccaaattaaagtcaagaactcggcctcagtcacggtgtctccagccagtgccatccagacgtcggctggggcgacagcaaaccggtttcaaagtggtagccgcagaaaggcagctcagcgctctgcaccttccagagccacggccctggtgggcacgggggcacctgggcatcctcaggcttcccctggggctgcgagcgctgaaaatggaggcacgcacttacctccagctaaggtgctactctccgacaagaagcctacaccccagcgggtgataaagctgaagaggactccgctgtgcgccaccgcgccttgcctgccctcccccacggccacgaggcaggccaactccctcaagccgcttcccggcgaagctgcccgtgccttgggagtgcggactgagaacgggaagaacaagggaaattgatgaaagtggtggacttgaaatttcccgttcatctcccaaagctttcaacccattcgacgcaaagaagtgacactttcttaatgcagcagaggggaagcttaggtttatgttgaggattctgttcctggaattgtgtgagctaggaatggaggaggggagactttcaatggttaaggctccatttctcattttcccaacttttatatgattgtctatgggcagtttgaatttctggttttcaatttattttttaatgattaattcgtattaaggcaacaagacagtacaacaaataatctctagagaggtccactttgttgctgaagtaaacgttacttgttgcaacccgaggatgggcatgaggtttggccttaggtattcctgtctgggaaaatggagggggtgatattagtggttccctgtactatatcacagccaagagagattagagagagaaaatgtagatcaaggcgagctgcctacaaattactctgtctccaaaggcaacgtgaaaagaaatgatggggaggaaaaaaccccatagattgaattagcactttgactctcacttaattcaacgattttctttcctagattggcttttcttactcttttctgttagtagatttatttataaacaccacaagaagatctcttgggatcagaattatataatatctttgaagtaaattattaaaatatcctatttaatttgaatagtgaagttttgaaaatactttgaaaaagagaagtaaaagtttaactttttaactaaagttagtatttgtttttcagaaatgaccactgaagattcattctgattatacaatatgatttttatgcataaaatttccatgtaacttgaatttaatatttttaaacagaatattttgactaatcctctattttttcatgactattcagttgtgtgtgtttattcgtaaatgttatgttttgtaattggatcacatatttctactttcagtgagagtatgccttcactatgttaaaaaataagctcataaaacagggtactttttattcaaatgcttatcattgtactttcattgctttgaaagagtaaagtaagtatactcaaaacattacgttttacaaaatcaaataaaacttttccataaaaagtggta

SEQ ID NO: 167973 - DNA, 2556 bp, Homo sapiens
  Payload ID: 13037
  Gene Symbol: KCTD18
  Gene Name: potassium channel tetramerization domain containing 18
  Uniprot ID: Q6PI47
  ENST ID: ENST00000409157
  CDS Start-End: 134-1414
acttccgcgtccgccccgcggcgtccggcggccgcgccgagggtctggcgggccgcagagggagaccaagacatcattgttttgaagtttctgaaagtgttgggcggcaaaaattcaggtgcctgggggagaaatggaaggccacaaggcagaagaagaggtgctagatgttctccgactgaacgtgggtggctgtatttacacagcccggcgggagtccttgtgccgcttcaaggactccatgttggcatctatgttcagtggtcgctttcctctaaaaacagatgagtcaggggcttgtgttattgaccgtgatggacgtctatttaaataccttttggattaccttcatggagaagttcagattcccacagatgagcaaacccgcatcgccctacaggaagaggctgattactttggcatcccttatccatacagcctgtctgaccatttggccaatgaaatggagacatattctttaaggtcaaatatagaacttaaaaaggctttaacagacttctgtgattcatatggcttagtctgcaataaaccaacagtttgggttctccactatcttaacacatctggtgcaagctgtgagagtagaattattggtgtatatgccacaaaaactgatggaacagacgctattgaaaagcagctgggaggaagaattcacagcaaaggcatttttaaaagagaggcgggaaataatgttcagtacatttggagctattattcagtagcagagttgaagaaaatgatggatgcctttgatgcttgggaaggaaaaggtgttagctactggcgggtgcctcatgagctgatagagtgttggactctagaagaacggcctttacttggaagcctgcgtcacatggctccaattcgaaagaggcgactgataacgttcaatgaagcggacgaaagtgtgaactataagactggtcctaagccagttagatttttgggcccttccacaagtacccaaattaaagtcaagaactcggcctcagtcacggtgtctccagccagtgccatccagacgtcggctggggcgacagcaaaccggtttcaaagtggtagccgcagaaaggcagctcagcgctctgcaccttccagagccacggccctggtgggcacgggggcacctgggcatcctcaggcttcccctggggctgcgagcgctgaaaatggaggcacgcacttacctccagctaaggtgctactctccgacaagaagcctacaccccagcgggtgataaagctgaagaggactccgctgtgcgccaccgcgccttgcctgccctcccccacggccacgaggcaggccaactccctcaagccgcttcccggcgaagctgcccgtgccttgggagtgcggactgagaacgggaagaacaagggaaattgatgaaagtggtggacttgaaatttcccgttcatctcccaaagctttcaacccattcgacgcaaagaagtgacactttcttaatgcagcagaggggaagcttaggtttatgttgaggattctgttcctggaattgtgtgagctaggaatggaggaggggagactttcaatggttaaggctccatttctcattttcccaacttttatatgattgtctatgggcagtttgaatttctggttttcaatttattttttaatgattaattcgtattaaggcaacaagacagtacaacaaataatctctagagaggtccactttgttgctgaagtaaacgttacttgttgcaacccgaggatgggcatgaggtttggccttaggtattcctgtctgggaaaatggagggggtgatattagtggttccctgtactatatcacagccaagagagattagagagagaaaatgtagatcaaggcgagctgcctacaaattactctgtctccaaaggcaacgtgaaaagaaatgatggggaggaaaaaaccccatagattgaattagcactttgactctcacttaattcaacgattttctttcctagattggcttttcttactcttttctgttagtagatttatttataaacaccacaagaagatctcttgggatcagaattatataatatctttgaagtaaattattaaaatatcctatttaatttgaatagtgaagttttgaaaatactttgaaaaagagaagtaaaagtttaactttttaactaaagttagtatttgtttttcagaaatgaccactgaagattcattctgattatacaatatgatttttatgcataaaatttccatgtaacttgaatttaatatttttaaacagaatattttgactaatcctctattttttcatgactattcagttgtgtgtgtttattcgtaaatgttatgttttgtaattggatcacatatttctactttcagtgagagtatgccttcactatgttaaaaaataagctcataaaacagggtactttttattcaaatgcttatcattgtactttcattgctttgaaagagtaaagtaagtatactcaaaacattacgttttacaaaatcaaataaaacttttccataaaaa

SEQ ID NO: 167974 - DNA, 2958 bp, Homo sapiens
  Payload ID: 13038
  Gene Symbol: KCTD19
  Gene Name: potassium channel tetramerization domain containing 19
  Uniprot ID: Q17RG1
  ENST ID: ENST00000304372
  CDS Start-End: 57-2837
gggaaccgttattggccgggtcacaagcccgcccgcccgctgctggagccgcgaccatggaggagtctggcatggctcatgaatcagcagaggacttgtttcatttcaacgtagggggctggcatttctcagttcccagaagcaaactctctcagtttccagactccctgctgtggaaagaggcttcagccttgacctcttcagaaagccagaggctatttatcgacagagatggttccacatttaggcacgtgcactattacctctacacctccaaactctccttctccagttgtgcagaactgaacttgctgtatgagcaagcattgggtttgcagctgatgcctttgctgcagactctagataacctgaaggaagggaaacaccatctacgcgtacggcctgcagacctacctgttgctgagagagcatctctgaactactggcgtacatggaagtgtattagcaaaccctcagaatttccaattaaaagcccagcctttacaggcctacatgataaggcacctctggggctcatggacacacccctgttagacacagaagaggaggtgcactactgcttcctgcccctagacctggtggccaaatatcccagcctagtgactgaagacaacctgctgtggctggctgagacggtggccctcatcgagtgcgagtgcagcgagttccgcttcattgtgaattttcttcgctcacagaagattttactaccggataatttctccaacattgatgtattagaagcagaagtggaaattctggaaatccctgcactcactgaagccgtaaggtggtaccggatgaacatgggtggctgttccccgaccacctgttctcccctgagccccgggaagggggcccgcacagccagcctggagtccgtgaaaccgctctacacaatggccctgggtctgctggtcaagtacccggactctgcgctgggccagcttcgcatcgagagcacgctagacggaagccgactgtacatcacagggaatggcgtcctctttcagcacgtcaagaactggctggggacttgccggctgcccctgacagagaccatttccgaggtatatgagctctgtgccttcctagacaaaagggacatcacctacgagccaatcaaagttgctttgaagactcatctggagccaaggactttggcacccatggatgtgctcaatgagtggacggcagagatcactgtgtattccccacaacagatcatcaaagtgtatgttggaagccactggtacgcaaccaccctgcagacactgctgaagtatccagaactgctgtccaaccctcagagagtgtactggatcacatatggacaaaccctgctcatccacggggatggccagatgttccgacacattctcaacttcctgagacttggcaaactgtttttaccatctgaatttaaggaatggcccctcttctgccaggaggtggaggaataccacattccatccctctcagaagcccttgcacaatgtgaagcatacaagtcatggactcaggagaaagaatctgaaaatgaagaagctttttccatcaggaggctgcatgtggtgacagaagggccagggtcactggtggagttcagtagagacactaaagaaaccacagcctacatgcctgtggacttcgaagactgcagtgacaggactccatggaacaaggctaagggaaacctggtcaggtccaaccagatggatgaggctgagcagtacactcggcccatccaggtgtccctatgccgaaatgccaagagggctggcaaccctagcacatactcacactgccgtggcttgtgtaccaatcctggacactgggggagccaccctgagagccccccaaagaagaaatgcaccacaatcaacctcacacagaaatctgaaaccaaagaccctcccgccactcccatgcaaaaactcatctccctggtgagagaatgggacatggtcaattgcaaacagtgggaattccagccactgacagccacacggagcagccccttggaggaggccaccctgcagctccccttgggaagcgaggctgcttcccagcccagcacctcagctgcctggaaagcccattccacagcctcagagaaggatccaggaccacaggcaggggctggagctggagcgaaagacaaggggccagagccaaccttcaagccatacttacccccaaaaagagctggcaccctgaaggactggagcaagcagaggaccaaggagagagaaagccctgcccctgagcagcctctgcccgaggccagtgaggtggacagcctaggggttatcctcaaagtgactcacccccccgtggtgggcagcgatggcttctgcatgttctttgaggacagcatcatctataccacggagatggacaacctcaggcacacaacacccacagccagtccccagccccaagaagtgactttcctgagtttctctctgtcctgggaagagatgttttatgcacagaaatgtcactgcttcctggctgacatcatcatggattccatcaggcaaaaggaccccaaagccatcacagccaaggtggtctccctggccaatcggctgtggaccctgcacatcagccccaagcagtttgtggtagatttgctggccatcaccggcttcaaggatgaccggcacacccaggagcgcctgtacagctgggtggagcttacactgcccttcgccaggaaatatggccgatgcatggacctgctcatccagaggggcctgtctaggtctgtctcttactccatcctgggaaagtacctacaagaggactagggtgcccagagatgcagcccctcatgccccacccgccaagtctcattttaattggagatagcccagaatgcatgtgcccatcagagggtacatatcagtctattttttattataaacaaat

SEQ ID NO: 167975 - DNA, 528 bp, Homo sapiens
  Payload ID: 13038
  Gene Symbol: KCTD19
  Gene Name: potassium channel tetramerization domain containing 19
  ENST ID: ENST00000567976
  CDS Start-End: 125-528
ggcgggtgtccccttcttccctcaacgctccacgtgcgtccctcctgaagctgcgtgctcagtcaaagaggacgaccatccccaataaaggaggaccagtcttcagtcaagggaggagtctggcatggctcatgaatcagcagaggacttgtttcatttcaacgtagggggctggcatttctcagttcccagaagcaaactctctcagtttccagactccctgctgtggaaagaggcttcagccttgacctcttcagaaagccagaggctatttatcgacagagatggttccacatttaggcacgtgcactattacctctacacctccaaactctccttctccagttgtgcagaactgaacttgctgtatgagcaagcattgggtttgcagctgatgcctttgctgcagactctagataacctgaaggaagggaaacaccatctacgcgtacggcctgcagacctacctgttgctgagagagcatctctgaactactggcgtacatggaagtgtattagcaaaccctc

SEQ ID NO: 167976 - DNA, 702 bp, Homo sapiens
  Payload ID: 13038
  Gene Symbol: KCTD19
  Gene Name: potassium channel tetramerization domain containing 19
  ENST ID: ENST00000562721
  CDS Start-End: 8-148
cgcgaccatggtacggagcccgctctggcgggggcgccaaaagcaccaaagcggcgaatgggggccgctgtggccaaggattggggctaagtggaggagtctggcatggctcatgaatcagcagaggacttgtttcatttcaacgtagggggctggcatttctcagttcccagaagcaaactctctcagtttccagactccctgctgtggaaagaggcttcagccttgacctcttcagaaagccagaggctatttatcgacagagatggttccacatttaggcacgtgcactattacctctacacctccaaactctccttctccagttgtgcagaactgaacttgctgtatgagcaagcattgggtttgcagctgatgcctttgctgcagactctagataacctgaaggaagggaaacaccatctacgcgtacggcctgcagacctacctgttgctgagagagcatctctgaactactggcgtacatggaagtgtattagcaaaccctcagaatttccaattaaaagcccagcctttacaggcctacatgataaggcacctctggggctcatggacacacccctgttagacacagaagaggaggtgcactactgcttcctgcccctagacctggtggccaaatatcccagcctagtgactgaagacaacctgctgtggctggctgagacggtggccctcatc

SEQ ID NO: 167977 - DNA, 423 bp, Homo sapiens
  Payload ID: 13038
  Gene Symbol: KCTD19
  Gene Name: potassium channel tetramerization domain containing 19
  ENST ID: ENST00000566295
  CDS Start-End: 196-423
aaaaattagccgggtgtggtggcacggcctgtagtcccagctactcgggaggctgaggcaggagaatcgcttgaacccgggaggtggaggttgcagtgaaccgagattgcaccactgcactccagcctgggcgacctgagtgacagagccagaccttgtctcaaaaaaaaaaaaaaaaaaaaggaggagtctggcatggctcatgaatcagcagaggacttgtttcatttcaacgtagggggctggcatttctcagttcccagaagcaaactctctcagtttccagactccctgctgtggaaagaggcttcagccttgacctcttcagaaagccagaggctatttatcgacagagatggttccacatttaggcacgtgcactattacctctacacctccaaactctccttctccagttgtgca

SEQ ID NO: 167978 - DNA, 530 bp, Homo sapiens
  Payload ID: 13038
  Gene Symbol: KCTD19
  Gene Name: potassium channel tetramerization domain containing 19
  ENST ID: ENST00000562841
  CDS Start-End: 1-348
tgcaaacagtgggaattccagccactgacagccacacggagcagccccttggaggaggccaccctgcagctccccttgggaagcgaggctgcttcccagcccagcacctcagctgcctggaaagcccattccacagcctcagagaaggatccaggaccacaggcaggggctggagctggagcgaaagacaaggggccagagccaaccttcaagccatacttacccccaaaaagagctggcaccctgaaggactggagcaagcagaggaccaaggagagagcttacactgcccttcgccaggaaatatggccgatgcatggacctgctcatccagaggggcctgtctaggtctgtctcttactccatcctgggaaagtacctacaagaggactagggtgcccagagatgcagcccctcatgccccacccgccaagtctcattttaattggagatagcccagaatgcatgtgcccatcagagggtacatatcagtctattttttattataaacaaataaaagattaaatcac

SEQ ID NO: 167979 - DNA, 3635 bp, Homo sapiens
  Payload ID: 13039
  Gene Symbol: KCTD2
  Gene Name: potassium channel tetramerization domain containing 2
  Uniprot ID: Q14681
  ENST ID: ENST00000322444
  CDS Start-End: 7-798
tccaagatggcggaactgcagctggacccggcgatggcggggctgggagggggcggcgggagtggggtgggcgacgggggtggcccagtccgcgggccccccagcccacgcccggctggccccacgccccgcgggcacggccgcccggctgccgccgtcgcgcagccgctggagccgggtcccggaccacccgagcgggcagggggcggcggcgcggcccgctgggtcaggctgaacgtgggaggcacctacttcgtgaccaccagacagaccttaggccgggagcccaagtcatttctctgccgcctctgctgccaggaggacccggagctggactcagacaaggatgagacaggagcctatctgattgacagggaccccacctactttggtcctatcctcaactacctccgccacgggaaactcatcatcactaaggagttggcagaagaaggtgtgctggaggaagcggagttttacaacatcgcgtcccttgtgcggctggttaaggaaaggatacgggacaatgagaacagaacttcacaaggccccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacgtgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcacctttctccagcagccgggaccctctggagagcttgttttccctccaagaagaggtttgagacaggcggcatcctgcactgagtcagacaagtgggagctgtaggaactgcacctgcagcctcttcttactccccattgaccctgtcttccttccctggctttttcaactggaccaaagatgaaggcacttatggaccctttgatggcttggagtggggaaggctgtttctttgaaagttgccaaatgtgttatgttgtgtctcagagagagttatttctgtgactctcttggaaatgccttgactgaatgtgcaatatttgtgtctcttggtttctaaccttggcggacctgctcccctctgtactgtccccagtggtatgtatgtatgtgctaggcagtctggggaccccctgtgtctctgaccacccccctgacccccgccattactttcttttctggagtgccatgctggcgaggatccggatgcggcagcaccctctttcgggctgcatccacagagtttgtgtccacactttctctccgagcatgtgggtctcgctgagcagtcatggaatgcggtagagccaggggaccctgtctgccccgaataactttcagtagtatggcagatggcacagagaaagggaaggggctctggggacttctccttctatgaaagcctcctcgagccaggtgctcctgggcaccttcagaagtgatgtcctgtgtgctccacagctcacctgcttgccaaggtacgtctgggtagtagtttctggaaatgactgcagactgtgccaaatgtcttttgagcttctgacctgaccatgcccagatggcataacttttccctaggaccctcagtctccttgtttctctgtatctgtagcatagcatagaacccggtatacaggggtttctgctgacacatcaacgtctacacacctatgcgccacattttacagctgtaaagtgttagatgaactgccgtcctcagtaaaagcagccaccccttcaagagtcacaggcatccatccagtcgtatctttcagagaaaaaaaaagttagatgtagccaaggaaagtagtgatcacgggaaggactgctctgagccgggtaggatggaggactttggaagaggcgctccttggccaggtccaatgagtaacatcagactgacagaggaaaagcagcttggtttgcggccttgtgcccagtctcgttgaggcgcttgtccctgtctgctttcctggggcatgcctgatcagcgtgggctggagctcctagaccaaccccagctttctcaccaggttcagcaaggaggcctgggggtcagacaccaatgttgagcacctcctgagggcgccgtttccttcattcctcttagattccatagttgccgccatgaaaagactgctcttgagccccaaggcacaggcacgtgctctgggaaatagacaggagtggtatttccgccctctcggagggctggtgttcaccaagtttccctcctcgctgcaacccaatgacacctgtattgttccagcgctccaggactctgggttcttaagatttctgggagcgttgttcacccaccccctttaggaaccaggctggtgttcttgcttgaaagcgttgtgccctctgagtgtctggctgatcacatcagagaggtctgcgtggcagtttggggctgtcacgtgaccagtgacccacactctctgctgcccagtactgccaagtggggagggtcctgcctttttctctgccccaggtctgggacgcaggtgatgccagccaggcccaggagtgcccagcatcccccaactgatgacacagtagcactgattctgtcttttcctcagaatctggcctttttccatggcaatgaggtggggcccagcctcctctaaagtgactttgtttctgcacagttgtaactgctcttggggatgtcagtgaggctgggagcagggagccacgggatgctgagagaggaggcccgagaggacaccccaccctccagcgtggcctttgatccagacttagggacgaggctgtcactggtgggcaccctctgttcctgtttgtgtgtttgaatagtctgaaatgctgtgactttttttgtgtgaataaagatatgaaacttctgaatctc

SEQ ID NO: 167980 - DNA, 3582 bp, Homo sapiens
  Payload ID: 13039
  Gene Symbol: KCTD2
  Gene Name: potassium channel tetramerization domain containing 2
  ENST ID: ENST00000375286
  CDS Start-End: 68-292
tctccctgccgagaaatgggccggcccggctgcgcgcgggcagcagcggtggcggcggcggtccaagatggcggaactgcagctggacccggcgatggcggggctgggagggggcgccgggtcccggaccacccgagcgggcagggggcggcggcgcggcccgctgggtcaggctgaacgtgggaggcacctacttcgtgaccaccagacagaccttaggccgggagcccaagtcatttctctgccgcctctgctgccaggaggacccggagctggactcagacaaggatgagacaggagcctatctgattgacagggaccccacctactttggtcctatcctcaactacctccgccacgggaaactcatcatcactaaggagttggcagaagaaggtgtgctggaggaagcggagttttacaacatcgcgtcccttgtgcggctggttaaggaaaggatacgggacaatgagaacagaacttcacaaggccccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacgtgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcacctttctccagcagccgggaccctctggagagcttgttttccctccaagaagaggtttgagacaggcggcatcctgcactgagtcagacaagtgggagctgtaggaactgcacctgcagcctcttcttactccccattgaccctgtcttccttccctggctttttcaactggaccaaagatgaaggcacttatggaccctttgatggcttggagtggggaaggctgtttctttgaaagttgccaaatgtgttatgttgtgtctcagagagagttatttctgtgactctcttggaaatgccttgactgaatgtgcaatatttgtgtctcttggtttctaaccttggcggacctgctcccctctgtactgtccccagtggtatgtatgtatgtgctaggcagtctggggaccccctgtgtctctgaccacccccctgacccccgccattactttcttttctggagtgccatgctggcgaggatccggatgcggcagcaccctctttcgggctgcatccacagagtttgtgtccacactttctctccgagcatgtgggtctcgctgagcagtcatggaatgcggtagagccaggggaccctgtctgccccgaataactttcagtagtatggcagatggcacagagaaagggaaggggctctggggacttctccttctatgaaagcctcctcgagccaggtgctcctgggcaccttcagaagtgatgtcctgtgtgctccacagctcacctgcttgccaaggtacgtctgggtagtagtttctggaaatgactgcagactgtgccaaatgtcttttgagcttctgacctgaccatgcccagatggcataacttttccctaggaccctcagtctccttgtttctctgtatctgtagcatagcatagaacccggtatacaggggtttctgctgacacatcaacgtctacacacctatgcgccacattttacagctgtaaagtgttagatgaactgccgtcctcagtaaaagcagccaccccttcaagagtcacaggcatccatccagtcgtatctttcagagaaaaaaaaagttagatgtagccaaggaaagtagtgatcacgggaaggactgctctgagccgggtaggatggaggactttggaagaggcgctccttggccaggtccaatgagtaacatcagactgacagaggaaaagcagcttggtttgcggccttgtgcccagtctcgttgaggcgcttgtccctgtctgctttcctggggcatgcctgatcagcgtgggctggagctcctagaccaaccccagctttctcaccaggttcagcaaggaggcctgggggtcagacaccaatgttgagcacctcctgagggcgccgtttccttcattcctcttagattccatagttgccgccatgaaaagactgctcttgagccccaaggcacaggcacgtgctctgggaaatagacaggagtggtatttccgccctctcggagggctggtgttcaccaagtttccctcctcgctgcaacccaatgacacctgtattgttccagcgctccaggactctgggttcttaagatttctgggagcgttgttcacccaccccctttaggaaccaggctggtgttcttgcttgaaagcgttgtgccctctgagtgtctggctgatcacatcagagaggtctgcgtggcagtttggggctgtcacgtgaccagtgacccacactctctgctgcccagtactgccaagtggggagggtcctgcctttttctctgccccaggtctgggacgcaggtgatgccagccaggcccaggagtgcccagcatcccccaactgatgacacagtagcactgattctgtcttttcctcagaatctggcctttttccatggcaatgaggtggggcccagcctcctctaaagtgactttgtttctgcacagttgtaactgctcttggggatgtcagtgaggctgggagcagggagccacgggatgctgagagaggaggcccgagaggacaccccaccctccagcgtggcctttgatccagacttagggacgaggctgtcactggtgggcaccctctgttcctgtttgtgtgtttgaatagtctgaaatgctgtgactttttttgtgtgaataaagatatgaaacttctgaatctcaagaa

SEQ ID NO: 167981 - DNA, 993 bp, Homo sapiens
  Payload ID: 13039
  Gene Symbol: KCTD2
  Gene Name: potassium channel tetramerization domain containing 2
  ENST ID: ENST00000581589
  CDS Start-End: 583-777
gatgcccaggagagggaatggaaacctggagctgggagtgaggttagagctgtaagatccaagacccagggagacaagaggaccctggggacgaataggaacagctgagcaagggatgctggaatcgaccttggtctctagttcgactcccgtgcaacgtgttgaggaggagccacctcctccaagcgcctaaagccgacccagaaacgcctcccaatccctccacaccgcggctcccgggatccgaagctggggagctgcttctgtccaatcaggctttgcatcccgggacgcttccggttatggcgtcattatgcagccagggatgagacaggagcctatctgattgacagggaccccacctactttggtcctatcctcaactacctccgccacgggaaactcatcatcactaaggagttggcagaagaaggtgtgctggaggaagcggagttttacaacatcgcgtcccttgtgcggctggttaaggaaaggatacgggacaatgagaacagaacttcacaaggccccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcag

SEQ ID NO: 167982 - DNA, 1339 bp, Homo sapiens
  Payload ID: 13040
  Gene Symbol: KCTD20
  Gene Name: potassium channel tetramerization domain containing 20
  ENST ID: ENST00000265344
  CDS Start-End: 123-506
ttctggctgcgcggcctgcgcgcgcctcccgggcggattccagccccgagcgggacagcgcggcggggagcgacgagatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaaggatgtttggaccaggaagagagtacaacttcactcggcccaatgagaagggagagtatgagattgctgaaggcatcagtgcaactgtatttcgcacagtgctggattattacaaaaccggtatcatcaattgtcctgatggcatctctatcccagatcttagagatacttgtgattatctctgcattaattttgacttcaacactatccgatgtcaagatctgagtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttg

SEQ ID NO: 167983 - DNA, 5619 bp, Homo sapiens
  Payload ID: 13040
  Gene Symbol: KCTD20
  Gene Name: potassium channel tetramerization domain containing 20
  Uniprot ID: Q7Z5Y7
  ENST ID: ENST00000373731
  CDS Start-End: 392-1651
taacttttccgtctgcaacctttaataattgagagggtatgcgcaactcagaaaagtgcgcccgctgaggttgggtgcagagtggactggaggaaaggcgacacccatttacggtgcggccccggacggggtccccagacacggccttcccggcgtgccacgcgcggaggggactcttaacgtgaagcgctgggtgactcagccgcgtggccgcgcggtccggggcggggggcgcgcgccgctgcggcacagccggtcccggctgcggcttctggctgcgcggcctgcgcgcgcctcccgggcggattccagccccgagcgggacagcgcggcggggagcgacgagatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaagacctctcacttgactatgcctctcagccagcaaatcttcagttccctcacataatgccccttgctgaagacatcaaaggttcttgcttccaaagtgggaataaacggaaccatgaaccttttattgctccagaaagatttggaaacagtagtgtgggctttggcagtaattcccattcccaagcaccagagaaagtgacgcttcttgtagatggcacacgttttgttgtgaatccacagattttcactgctcatccggataccatgctgggaaggatgtttggaccaggaagagagtacaacttcactcggcccaatgagaagggagagtatgagattgctgaaggcatcagtgcaactgtatttcgcacagtgctggattattacaaaaccggtatcatcaattgtcctgatggcatctctatcccagatcttagagatacttgtgattatctctgcattaattttgacttcaacactatccgatgtcaagatctgagtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagatttgtgtctcattaatgcagtgaacaattcaaaaccacacagattccttggcaggaaggataatggaataacagtgttgatgagacctttttagcttcaaggtttcggagtctaaacaaatggatgattcatttggaatgaaactcacaatgcaagtagaaggacctctccaaatcaggccagttgggttatcctggcttggaatctggtgtgaaaccataggtcttaacactctggagcagcacattgctgtggatatgtccaggagaccttagatatggcttaaaggctttcaagatgaggacagaaattgcttacaattgctcagtttctcaacagaaagactcataagagtgccagcatggggtacatggagtgaagctgggtgggaagcatcatctgcacagtccctgtcctagtgcaggacttttctctgtatgttttcataccatgggatttttggatatcagtgtattttggttcttgaaatagcctaatagctgctcacacattgggtaggaatattataccaatgtcatccccaaaggaagggtgagctgaatggaaattaagcccagtcattttatttgatctattagctctgttatcagtgcatgatcacccagatcaccctcctcagcccacacagtgctgaaccatcttccctcctgttctccatggctattaatagtatagctaaatttagagtgcagagccagatataagtattttggaattatctcccagtttgtggtagaagctgactggaatacaggttgagtatctcttatccaaaatgctagggaccagaaaggtttcagattttttcagattttggaatacttaacagttgagcaccccaaatctgaaaggcttctgaacgtcatgtcagcactcaaaaaagtggattttggagcacttcaaatttcggatttttggatttgggatgctcatcctgtgtaggagaggctactcgattccatttaatgactgtcctagtcataatcatccaaagataaaagccaggtagatgttgaaagctctttccagggctgaaaaagtgttcttacgttctctgcatgtgactagcatcactgtggaaattaatgctctgttcttcactagaatgtagtaagtggttaaactgagctatcccccacctgatgactattggcatccatttgcaaggccaatggcctggattaagggttaggattatttgtagctagaaggtaattttatttctgtgaaactaattggctcatatttgaggttaggtgtggccttgaccttaccagtacatttatacccactaccagttgactagcccagataattgttaaatggtgcttcttttctgcttctcagtagacttccatgccattacaaaggaaatttgaattacctagtgtttgtatattccatgataactatgtataacttctgttacacagcttatgtattgttaacatttaagtgtaaaccatgccacagctaacacttaaaaatgaaaactaattagttcttgcttagggaaaatgccaggtatgaagtatggcatatacttgacactgtcctgtgtaaccctttactttgctcaggctttcaagattgagtcttttttcccccaaattaggttaacatgcatttgaccccaacctgtggggtttgagtaagctggaaatctgtgacggtaggctttctagtgtcacgaggtggtggtgactgaaggaaaagctgggatcacaggttccttctgatggagaggaaggtttatttctatgcccctcccaccaccctccacctagagctcacccaagcctgctccagtcccaggggcaggccattctgcaaaagcaggacctcacagaaacaagggctgggttgaggtcacccccttcagagttggttcctggccagatgggtaagaggcatttgtaattttaaaaatgtgaaacttgggtttggtgttttcttctaagtgcctaaataagcaagccaggctgttgatattttagccagagaaatcggcaagccaagattaacccgaatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagttgcccaaagggtccccctctaagtaaaacaaatattcagaccacaggctttaatgtaaactgtcaaaaagtgggatgtggaggatttttgttaagtgtcaatcgaagttaaaaagcaagggtttttggccaggcgtggtggctcacgcctgtaatcccagcactttgggaggccgaggccggcaaatcacctaaggtcaggagttcgagaccagcctggccaacatggtgaaaccccgtctctactaaaaatacaaaaaaattagcccggtgtggtggcaagtgcctgtagtcccagctacttgggaggctgaggcaggagaactgcttgaacccgggaggtagaggttgcagtgagccacgatcatgccactgcactccagcctgggcaacagagcaagactccatctcaaaaaagaaaaaaaaaaattaaaggttttggctgggtgcagtggctcatgccggtaatcccagcactttgggaggccaaggtgggaggatcacttgaggtcaggagtttcagactggcctgggcaacgtaaaaaattaaaaaaatagccaggcatggacatggtagtgcatacctgtggtcccagccactcaagaggctgagacaggatgattgcttgagcccaggaggatgaggctgcagtgagccatgatgacgctactgcactccagcctggatgacagggcaagaccctgtctcaatattttaagtcaagggtttgtagtaatgtattcagtgccacttcttgccatcactttgcaattattgaaatgggaatactgagctcagaaagcaaatatgatgctttcatgggagatggagccacatttgtgttctgggtgggatcactagtgcaggagaacattacattttcttctgaaggcaaaatgcttgtaggttttgcctctactttgtatttacttttaaaattgcacttgttcacctaccagtgtttacgaaatcctgtatttgggatgctttttctataataaaatattataatttgtg

SEQ ID NO: 167984 - DNA, 4094 bp, Homo sapiens
  Payload ID: 13040
  Gene Symbol: KCTD20
  Gene Name: potassium channel tetramerization domain containing 20
  Uniprot ID: Q7Z5Y7
  ENST ID: ENST00000449081
  CDS Start-End: 131-892
gctgcggcttctggctgcgcggcctgcgcgcgcctcccgggcggattccagccccgagcgggacagcgcggcggggagcgacgagatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaaggtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagatttgtgtctcattaatgcagtgaacaattcaaaaccacacagattccttggcaggaaggataatggaataacagtgttgatgagacctttttagcttcaaggtttcggagtctaaacaaatggatgattcatttggaatgaaactcacaatgcaagtagaaggacctctccaaatcaggccagttgggttatcctggcttggaatctggtgtgaaaccataggtcttaacactctggagcagcacattgctgtggatatgtccaggagaccttagatatggcttaaaggctttcaagatgaggacagaaattgcttacaattgctcagtttctcaacagaaagactcataagagtgccagcatggggtacatggagtgaagctgggtgggaagcatcatctgcacagtccctgtcctagtgcaggacttttctctgtatgttttcataccatgggatttttggatatcagtgtattttggttcttgaaatagcctaatagctgctcacacattgggtaggaatattataccaatgtcatccccaaaggaagggtgagctgaatggaaattaagcccagtcattttatttgatctattagctctgttatcagtgcatgatcacccagatcaccctcctcagcccacacagtgctgaaccatcttccctcctgttctccatggctattaatagtatagctaaatttagagtgcagagccagatataagtattttggaattatctcccagtttgtggtagaagctgactggaatacaggttgagtatctcttatccaaaatgctagggaccagaaaggtttcagattttttcagattttggaatacttaacagttgagcaccccaaatctgaaaggcttctgaacgtcatgtcagcactcaaaaaagtggattttggagcacttcaaatttcggatttttggatttgggatgctcatcctgtgtaggagaggctactcgattccatttaatgactgtcctagtcataatcatccaaagataaaagccaggtagatgttgaaagctctttccagggctgaaaaagtgttcttacgttctctgcatgtgactagcatcactgtggaaattaatgctctgttcttcactagaatgtagtaagtggttaaactgagctatcccccacctgatgactattggcatccatttgcaaggccaatggcctggattaagggttaggattatttgtagctagaaggtaattttatttctgtgaaactaattggctcatatttgaggttaggtgtggccttgaccttaccagtacatttatacccactaccagttgactagcccagataattgttaaatggtgcttcttttctgcttctcagtagacttccatgccattacaaaggaaatttgaattacctagtgtttgtatattccatgataactatgtataacttctgttacacagcttatgtattgttaacatttaagtgtaaaccatgccacagctaacacttaaaaatgaaaactaattagttcttgcttagggaaaatgccaggtatgaagtatggcatatacttgacactgtcctgtgtaaccctttactttgctcaggctttcaagattgagtcttttttcccccaaattaggttaacatgcatttgaccccaacctgtggggtttgagtaagctggaaatctgtgacggtaggctttctagtgtcacgaggtggtggtgactgaaggaaaagctgggatcacaggttccttctgatggagaggaaggtttatttctatgcccctcccaccaccctccacctagagctcacccaagcctgctccagtcccaggggcaggccattctgcaaaagcaggacctcacagaaacaagggctgggttgaggtcacccccttcagagttggttcctggccagatgggtaagaggcatttgtaattttaaaaatgtgaaacttgggtttggtgttttcttctaagtgcctaaataagcaagccaggctgttgatattttagccagagaaatcggcaagccaagattaacccgaatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagttgcccaaagggtccccctctaagtaaaacaaatattcagaccacaggctttaatgtaaactgtcaaaaagtgggatgtggaggatttttgttaagtgtcaatcgaagttaaaaagcaagggtttttggccaggcgtggtggctcacgcctgtaatcccagcactttgggaggccgaggccggcaaatcacctaaggtcaggagttcgagaccagcctggccaacatggtgaaaccccgtctctactaaaaa

SEQ ID NO: 167985 - DNA, 597 bp, Homo sapiens
  Payload ID: 13040
  Gene Symbol: KCTD20
  Gene Name: potassium channel tetramerization domain containing 20
  ENST ID: ENST00000460983
  CDS Start-End: 337-597
ctggctgcgcggcctgcgcgcgcctcccgggcggattccagccccgagcgggacagcgcggcggggagcgacgagatgaggtgtagtggcaagatttcagctcactgcagctttgacctccgggcttaagcagtcctcccacgtcagccttgcccaagtagttgggactacagatgaagtctcactctgttgcccaagctgcagtgcaatgtcgctatcttggcttactgcaacctccgcttcccgaagcgattctactgccccagcctcctgagtagctgggactacaggatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaagacctctcacttgactatgcctctcagccagcaaatcttcagttccctcacataatgccccttgctgaagacatcaaaggttcttgcttccaaagtgggaat

SEQ ID NO: 167986 - DNA, 547 bp, Homo sapiens
  Payload ID: 13040
  Gene Symbol: KCTD20
  Gene Name: potassium channel tetramerization domain containing 20
  ENST ID: ENST00000498267
  CDS Start-End: 255-547
agccggtcccggctgcggcttctggctgcgcggcctgcgcgcgcctcccgggcggattccagccccgagcgggacagcgcggcggggagcgacgagcctcgggtggttcatcccgccggagaggaatggcgagaacctggagtgttgactggcaaaacatttgcagacgcggtttttctggcaattaattggctccattaaaaattaggatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaagacctctcacttgactatgcctctcagccagcaaatcttcagttccctcacataatgccccttgctgaagacatcaaaggttcttgcttccaaagtgggaataaacggaaccatgaaccttttattgctccaga

SEQ ID NO: 167987 - DNA, 1494 bp, Homo sapiens
  Payload ID: 13040
  Gene Symbol: KCTD20
  Gene Name: potassium channel tetramerization domain containing 20
  ENST ID: ENST00000481911
  CDS Start-End: 138-416
ggtcccggctgcggcttctggctgcgcggcctgcgcgcgcctcccgggcggattccagccccgagcgggacagcgcggcggggagcgacgagatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaaggatgtttggaccaggaagagagtacaacttcactcggcccaatgagaagggagagtatgagattgctgaaggcatcagtgcaactgtatttcgcacagtgctggtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattctt

SEQ ID NO: 167988 - DNA, 578 bp, Homo sapiens
  Payload ID: 13040
  Gene Symbol: KCTD20
  Gene Name: potassium channel tetramerization domain containing 20
  ENST ID: ENST00000483557
  CDS Start-End: 250-578
gctgcggcacagccggtcccggctgcggcttctggctgcgcggcctgcgcgcgcctcccgggcggattccagccccgagcgggacagcgcggcggggagcgacgagtgcaaggaatatgtagagataattccactatcaaagactgtatatacattttccaagatggggagatgatggtgataaaactattttgctgttccaggatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaagacctctcacttgactatgcctctcagccagcaaatcttcagttccctcacataatgccccttgctgaagacatcaaaggttcttgcttccaaagtgggaataaacggaaccatgaaccttttattgctccagaaagatttggaaacagtagtgtgggctttggcagtaa

SEQ ID NO: 167989 - DNA, 5345 bp, Homo sapiens
  Payload ID: 13040
  Gene Symbol: KCTD20
  Gene Name: potassium channel tetramerization domain containing 20
  Uniprot ID: Q7Z5Y7
  ENST ID: ENST00000536244
  CDS Start-End: 553-1377
taacttttccgtctgcaacctttaataattgagagggtatgcgcaactcagaaaagtgcgcccgctgaggttgggtgcagagtggactggaggaaaggcgacacccatttacggtgcggccccggacggggtccccagacacggccttcccggcgtgccacgcgcggaggggactcttaacgtgaagcgctgggtgactcagccgcgtggccgcgcggtccggggcggggggcgcgcgccgctgcggcacagccggtcccggctgcggcttctggctgcgcggcctgcgcgcgcctcccgggcggattccagccccgagcgggacagcgcggcggggagcgacgagatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaaggatgtttggaccaggaagagagtacaacttcactcggcccaatgagaagggagagtatgagattgctgaaggcatcagtgcaactgtatttcgcacagtgctggattattacaaaaccggtatcatcaattgtcctgatggcatctctatcccagatcttagagatacttgtgattatctctgcattaattttgacttcaacactatccgatgtcaagatctgagtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagatttgtgtctcattaatgcagtgaacaattcaaaaccacacagattccttggcaggaaggataatggaataacagtgttgatgagacctttttagcttcaaggtttcggagtctaaacaaatggatgattcatttggaatgaaactcacaatgcaagtagaaggacctctccaaatcaggccagttgggttatcctggcttggaatctggtgtgaaaccataggtcttaacactctggagcagcacattgctgtggatatgtccaggagaccttagatatggcttaaaggctttcaagatgaggacagaaattgcttacaattgctcagtttctcaacagaaagactcataagagtgccagcatggggtacatggagtgaagctgggtgggaagcatcatctgcacagtccctgtcctagtgcaggacttttctctgtatgttttcataccatgggatttttggatatcagtgtattttggttcttgaaatagcctaatagctgctcacacattgggtaggaatattataccaatgtcatccccaaaggaagggtgagctgaatggaaattaagcccagtcattttatttgatctattagctctgttatcagtgcatgatcacccagatcaccctcctcagcccacacagtgctgaaccatcttccctcctgttctccatggctattaatagtatagctaaatttagagtgcagagccagatataagtattttggaattatctcccagtttgtggtagaagctgactggaatacaggttgagtatctcttatccaaaatgctagggaccagaaaggtttcagattttttcagattttggaatacttaacagttgagcaccccaaatctgaaaggcttctgaacgtcatgtcagcactcaaaaaagtggattttggagcacttcaaatttcggatttttggatttgggatgctcatcctgtgtaggagaggctactcgattccatttaatgactgtcctagtcataatcatccaaagataaaagccaggtagatgttgaaagctctttccagggctgaaaaagtgttcttacgttctctgcatgtgactagcatcactgtggaaattaatgctctgttcttcactagaatgtagtaagtggttaaactgagctatcccccacctgatgactattggcatccatttgcaaggccaatggcctggattaagggttaggattatttgtagctagaaggtaattttatttctgtgaaactaattggctcatatttgaggttaggtgtggccttgaccttaccagtacatttatacccactaccagttgactagcccagataattgttaaatggtgcttcttttctgcttctcagtagacttccatgccattacaaaggaaatttgaattacctagtgtttgtatattccatgataactatgtataacttctgttacacagcttatgtattgttaacatttaagtgtaaaccatgccacagctaacacttaaaaatgaaaactaattagttcttgcttagggaaaatgccaggtatgaagtatggcatatacttgacactgtcctgtgtaaccctttactttgctcaggctttcaagattgagtcttttttcccccaaattaggttaacatgcatttgaccccaacctgtggggtttgagtaagctggaaatctgtgacggtaggctttctagtgtcacgaggtggtggtgactgaaggaaaagctgggatcacaggttccttctgatggagaggaaggtttatttctatgcccctcccaccaccctccacctagagctcacccaagcctgctccagtcccaggggcaggccattctgcaaaagcaggacctcacagaaacaagggctgggttgaggtcacccccttcagagttggttcctggccagatgggtaagaggcatttgtaattttaaaaatgtgaaacttgggtttggtgttttcttctaagtgcctaaataagcaagccaggctgttgatattttagccagagaaatcggcaagccaagattaacccgaatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagttgcccaaagggtccccctctaagtaaaacaaatattcagaccacaggctttaatgtaaactgtcaaaaagtgggatgtggaggatttttgttaagtgtcaatcgaagttaaaaagcaagggtttttggccaggcgtggtggctcacgcctgtaatcccagcactttgggaggccgaggccggcaaatcacctaaggtcaggagttcgagaccagcctggccaacatggtgaaaccccgtctctactaaaaatacaaaaaaattagcccggtgtggtggcaagtgcctgtagtcccagctacttgggaggctgaggcaggagaactgcttgaacccgggaggtagaggttgcagtgagccacgatcatgccactgcactccagcctgggcaacagagcaagactccatctcaaaaaagaaaaaaaaaaattaaaggttttggctgggtgcagtggctcatgccggtaatcccagcactttgggaggccaaggtgggaggatcacttgaggtcaggagtttcagactggcctgggcaacgtaaaaaattaaaaaaatagccaggcatggacatggtagtgcatacctgtggtcccagccactcaagaggctgagacaggatgattgcttgagcccaggaggatgaggctgcagtgagccatgatgacgctactgcactccagcctggatgacagggcaagaccctgtctcaatattttaagtcaagggtttgtagtaatgtattcagtgccacttcttgccatcactttgcaattattgaaatgggaatactgagctcagaaagcaaatatgatgctttcatgggagatggagccacatttgtgttctgggtgggatcactagtgcaggagaacattacattttcttctgaaggcaaaatgcttgtaggttttgcctctactttgtatttacttttaaaattgcacttgttcacctaccagtgtttacgaaatcctgtatttgggatgctttttctataataaaatattataatttgtg

SEQ ID NO: 167990 - DNA, 3585 bp, Homo sapiens
  Payload ID: 13041
  Gene Symbol: KCTD21
  Gene Name: potassium channel tetramerization domain containing 21
  Uniprot ID: Q4G0X4
  ENST ID: ENST00000340067
  CDS Start-End: 280-1062
aaggccagccggccggacaccggcggggacgaggcggggcgcagagcaactcgctgcaatgcctcctgggagatggagttcgctctcgacgcgccgagctgcgaggagcccagagagaactaccagtcccggaaggcagcgcacagaccccggaccgccacgcccctgggctgggctcctaccctccgcccccctcgcaaagctgcgctggccgctcgcggagggagaggctgcagagcgagggcaggaggactacttccagcaacccagtctcctgccatgtccgaccccatcacgctgaacgtcggggggaagctctatacaacctcactggcgaccctgaccagcttccctgactccatgctaggcgccatgttcagcgggaagatgcccaccaagagggacagccagggcaactgcttcattgaccgtgacggcaaagtgttccgctatatcctcaacttcctgcggacctcccaccttgacctgcctgaggacttccaggagatggggctgctccgcagggaggccgacttctaccaggtgcagcccctgattgaggccctgcaggagaaggaagtggagctctccaaggccgagaagaatgccatgctcaacatcacactgaaccagcgtgtgcagacggtccacttcactgtgcgcgaggcaccccagatctacagcctctcctcttccagcatggaggtcttcaacgccaacatcttcagcacctcctgcctcttcctcaagctccttggctctaagctcttctactgctccaatggcaatctctcctccatcaccagccacttgcaggaccccaaccacctgactctggactgggtggccaatgtggagggcctgccagaggaggagtacaccaagcagaacctcaagaggctctgggtggtgcccgccaacaagcagatcaacagcttccaggtcttcgtggaagaggtactgaaaatcgctctgagcgatggcttctgcatcgattcttctcacccacatgctctggattttatgaacaataagattattcgattaatacggtacaggtaaaaggaccccaacaacactggagatggggagtcccaggaagctcatgtcagccaggtcttggagggcatctcgccagtggtgcgaggcaggggactatactaatctgtattaattgtgtagcaggacttgattccccccatgatgaagtccaccttttggaatccagtgtcctctgaacagaaccaccttttttcttgccattttgagctgcagacaggcggtttattatgacaagtgaagagtcagctgatgtgtactaaaggaggccataggaggattttccagccaggacaaaagagcagcagttttctcctgggctccatctctctgtaccgctagccagtgccgcatttatccatctgtaagaaggccctggtggagaggatgggatgagaacaagaggctacctccagttaaccaggacataaagtccccagcggttcctgtcacacctgctcctccctccccagggtgcatccatgatcgtggatgtttgcccaggggtgaccatgtttggctggcttggaatgctgtgcattctcagagctctgttagtgtcccctcttgggggtcagagatgaggtgtggcagggtctagaggaatgagtgtccaggcagagttcagaaggtaggaatgtccctcttgatagggctgaatcaagggattcctggctttagaaagggtctgctatctttgcaaaaatgtgcaagtatctgtagccagtgtaatgaaatcacttccaaatccagcctgttacctgacttttgtcattgttttcccaaaaatttgaggtatcattgaaacaggtcattttaaacaaatctattacggattctcagggttggaaataattcgatgattgcttagtcctcccccacccctagaacaccccagcacatctgaagatgagcgcctctccctgggtacctgcaagtgatcaccttggcctgcttgcataccttggctgataggaagcgcgccatccccaaggcagctcctgctgtggttggacagtgctgactgttagacagttcttccctatattgagccaaaatctgtcctgccacttgctggatcttggttgcagaccttcccattcacccagttatatatctttgctttcaaaatagtcaccttgagagaccagacatttttctgaaaacatcattactcagaattcagattcccctctgggatctgtcttcagaatcaaagttagctcttttctatcccctgtaagtcagtccccttttgttgtagcttcacctcgtttgtgacccccacttcacccaccttccccaccatctgtggctccatatacctttcgaccattttctgctggaagaggaagattcacggcccctgaggagatccagaggaaagagacggtctccaagggtgctgtgcagcaaggagcccaggagtggtatgaaccgtaacagtgcccttagagtaaatgtgcggcccctaagaccctgccctcaggaaggcggccttcccctgcagtcctgtgtcccacccctgggtctctgtagggtgccatccagggcaagcaacccaagcactgcttcccaccgggtgatgagccatgcaggcctccaaactgcacgtcatgattcatccctaaagtgagtttggccttgagagtccccagggtcctcccccactgggcaggggtcctcaaagccaaggaagcctggtgacacaggcacccatgggaggtgggcccagaaaggggcttcccatagataggccctgtgagtagggagcttgtacactgggccatgggcagcgccagttcccttgagcagtaaaggcccttttccccctacggtgggacccaggagtctctctgacagcttttctgccaggcacagtggctcatgcctgtaatcccaacactctgggaggccgaggcgggaagatcacttgaggtcaggagttcaagaccagcctggccaacatggtgaaacgtcgtctctgctaaaaatacaaaaattagctgggtgtggtgacaggcgcctataaccccagctatttgggaggctgaggcagtagaatcgcttgaacccagatagcagaggttgcagtgagctgagagtgtgccattgcagagagactccatcccaaaaaaagacagctgtcccaggccaagggtacttgggagagcccctcatggagaacctagtttagaccaagtagcagaagctgtggtcataacaaaacaatttgaggaagaaatcttacaaatcaccactgccctttctccttttccataaaactgtccatcttttcggtgctccctaatccaagcagcttgactttagagaagttgcagaagcagtgaagccactaacatgctgtgtgactttatgcaagtcactcacctcactgagccacctccatttcttcatctgtgaaataggcataacagtaatacataaccctacctacctcacagggctgttgtgaggatcaaatgaaataatgtaacgtgagaatacagtataaatgataaagga

SEQ ID NO: 167991 - DNA, 558 bp, Homo sapiens
  Payload ID: 13041
  Gene Symbol: KCTD21
  Gene Name: potassium channel tetramerization domain containing 21
  ENST ID: ENST00000529350
  CDS Start-End: 212-558
gcgctggccgctcgcggagggagaggctgcagagcgagggcaggagatgcagaggagaaggaatgaattccagctgagagacctggccgatgcatgggatttgtcttcaaggtccaggcagaggggatggcagatgccaaattgcagaagtcgaagagggcccagtatggttggtctgtaaagactacttccagcaacccagtctcctgccatgtccgaccccatcacgctgaacgtcggggggaagctctatacaacctcactggcgaccctgaccagcttccctgactccatgctaggcgccatgttcagcgggaagatgcccaccaagagggacagccagggcaactgcttcattgaccgtgacggcaaagtgttccgctatatcctcaacttcctgcggacctcccaccttgacctgcctgaggacttccaggagatggggctgctccgcagggaggccgacttctaccaggtgcagcccctgattgaggccctgcaggagaaggaagtggagctctccaaggccgagaagaatgccatgctcaacatcacact

SEQ ID NO: 167992 - DNA, 726 bp, Homo sapiens
  Payload ID: 13041
  Gene Symbol: KCTD21
  Gene Name: potassium channel tetramerization domain containing 21
  ENST ID: ENST00000526208
  CDS Start-End: 231-726
agagcgagggcaggaggtgggtgcggcacggccggggtcgcggggctcggggactaccggcgaggatgcagaggagaaggaatgaattccagctgagagacctggccgatgcatgggatttgtcttcaaggtccaggcagaggggatggcagatgccaaattgcagaagtcgaagagggcccagtatggttggtctgtaaagactacttccagcaacccagtctcctgccatgtccgaccccatcacgctgaacgtcggggggaagctctatacaacctcactggcgaccctgaccagcttccctgactccatgctaggcgccatgttcagcgggaagatgcccaccaagagggacagccagggcaactgcttcattgaccgtgacggcaaagtgttccgctatatcctcaacttcctgcggacctcccaccttgacctgcctgaggacttccaggagatggggctgctccgcagggaggccgacttctaccaggtgcagcccctgattgaggccctgcaggagaaggaagtggagctctccaaggccgagaagaatgccatgctcaacatcacactgaaccagcgtgtgcagacggtccacttcactgtgcgcgaggcaccccagatctacagcctctcctcttccagcatggaggtcttcaacgccaacatcttcagcacctcctgcctcttcctcaagctccttggctctaagctcttctact

SEQ ID NO: 167993 - DNA, 499 bp, Homo sapiens
  Payload ID: 13041
  Gene Symbol: KCTD21
  Gene Name: potassium channel tetramerization domain containing 21
  ENST ID: ENST00000525447
  CDS Start-End: 79-499
tgacagcaaaggacaggccaccaggagccaagagcatcttcatggcaaggactacttccagcaacccagtctcctgccatgtccgaccccatcacgctgaacgtcggggggaagctctatacaacctcactggcgaccctgaccagcttccctgactccatgctaggcgccatgttcagcgggaagatgcccaccaagagggacagccagggcaactgcttcattgaccgtgacggcaaagtgttccgctatatcctcaacttcctgcggacctcccaccttgacctgcctgaggacttccaggagatggggctgctccgcagggaggccgacttctaccaggtgcagcccctgattgaggccctgcaggagaaggaagtggagctctccaaggccgagaagaatgccatgctcaacatcacactgaaccagcgtgtgcagacggtccacttcactgtgcgcgaggcaccccagatctacagcctctcctcttccagca

SEQ ID NO: 167994 - DNA, 538 bp, Homo sapiens
  Payload ID: 13041
  Gene Symbol: KCTD21
  Gene Name: potassium channel tetramerization domain containing 21
  ENST ID: ENST00000528776
  CDS Start-End: 427-538
aaagctgcgctggccgctcgcggagggagaggctgcagagcgagggcaggagacaaatgaccgggagccatgacgtcatcgggggcgcaggaaagcaggtgctctgctgcttttgcaagcagagaaataagagtttgggcacctacccaggggtcccagggaatgccctgtggctcctgacctcccccgcctgtaatgctctgagcacttcagcagtaatgcatggaagagataagggtctgtgacccatggaactgtccaagtcctctctgacacccgcttcttttcctgccgtgaaggctggagttctgtggcgtaatcacggctcactgcagcctcaacctcccagactcaagcgatcctcccacctcagcctcccaagtagttgggactacaggactacttccagcaacccagtctcctgccatgtccgaccccatcacgctgaacgtcggggggaagctctatacaacctcactggcgaccctgaccagcttccctgactccatgctaggcgccatgttcagcgggaagatgc

SEQ ID NO: 167995 - DNA, 559 bp, Homo sapiens
  Payload ID: 13041
  Gene Symbol: KCTD21
  Gene Name: potassium channel tetramerization domain containing 21
  ENST ID: ENST00000530018
  CDS Start-End: 329-543
aaagctgcgctggccgctcgcggagggagaggctgcagagcgagggcaggagacaaatgaccgggagccatgacgtcatcgggggcgcaggaaagcaggtgctctgctgcttttgcaagcagagaaataagagtttgggcacctacccaggggtcccagggaatgccctgtggctcctgacctcccccgcctgtaatgctctgagcacttcagcagtaatgcatggaagagataagggtctgtgacccatggaactgtccaagtcctctctgacacccgcttcttttcctgccgtgaaggactacttccagcaacccagtctcctgccatgtccgaccccatcacgctgaacgtcggggggaagctctatacaacctcactggcgaccctgaccagcttccctgactccatgctaggcgccatgttcagcgggaagatgcccaccaagagggacagccagggcaactgcttcattgaccgtgacggcaaagtgttccgctatatcctcaacttcctgcggacctcccaccttgacctgcctgaggacttccaggagatg

SEQ ID NO: 167996 - DNA, 3931 bp, Homo sapiens
  Payload ID: 13042
  Gene Symbol: KCTD3
  Gene Name: potassium channel tetramerization domain containing 3
  Uniprot ID: Q9Y597
  ENST ID: ENST00000259154
  CDS Start-End: 295-2742
gtcggtggcagcggagcacggagaagaggcccgggcggcccggcggcctggaggccgcgaaaggtggaggccgggccgcccttgtgcaccgcaggattgacccgggaaggggcagaagctagcgagccccgcccggccgccgggaaggtgggggaagccccgtgcaccccccgccctccggccgccgccgccccgctggccctgcagccgtcgccgctgcctcgggctacagccccgggctcggcggtcccggctggggaaggagggcggcgagcgcgtccggagccgccggagatggcgggagggcactgcggcagcttccccgcggcggcggccggcagcggcgagatcgtccaactgaacgtaggggggaccagatttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagaatcaaagaatcttcaggatggcagcaagtgtttacgagcccatatttggattggactatcgaacgagtagctttaaatgcaaaggtggttggagggccacatggagacaaagacaaaatggttgctgttgcctcagagagtagcatcatcttgtggagtgttcaggatgggggaagtggaagtgaaattggagtgttcagcctgggtgttcctgtagatgctctcttctttattggtaaccagttggtggccacgagtcatacagggaaagtgggagtgtggaatgctgtcactcagcactggcaggttcaagatgttgttcctataactagttatgacactgctggatcattccttctgcttggatgtaacaatggatcaatatattacatagatatgcagaagttccccttgcgaatgaaagataatgatcttcttgtaactgaactgtatcatgatccttcaaatgatgctattactgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtggattggaagtgcataaaatagctgaaggtttttcagaatccaagaaaaggtcatcagaagatgaaaatgaaaataaaatagagtttaggaagaaaggaggatttgaagggggaggattccttggaagaaagaaagttccctatctggcgtcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcgttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaatttactatattgccagtggtttcacaacagttctcttgtatttatttatcaattaaatcaaataaaaatgattatgtcaa

SEQ ID NO: 167997 - DNA, 751 bp, Homo sapiens
  Payload ID: 13042
  Gene Symbol: KCTD3
  Gene Name: potassium channel tetramerization domain containing 3
  ENST ID: ENST00000448333
  CDS Start-End: 1-640
atttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagagtgttttggctgggcacggtgggtcacgcctgtaatcccagcactttgggaggccgagatgggtggagttcaagatcagcccgaccaacatggtgaaaccccatctctactgaagatacaaaaattagccaggtgtggtgatgcatgcctgtaatcccagctactcgggaggctgaggcaggagaatcacttgaacccaggaggtgg

SEQ ID NO: 167998 - DNA, 589 bp, Homo sapiens
  Payload ID: 13042
  Gene Symbol: KCTD3
  Gene Name: potassium channel tetramerization domain containing 3
  ENST ID: ENST00000452413
  CDS Start-End: 1-505
tgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagtctgtgtggtgtcagtttggtttctagatccagccaagagcccacataactaaaagggcatttggagaatatgtgagatccaggctgttgactgtactacaatatcctcatttacagtgagggaatgtgaggg

SEQ ID NO: 167999 - DNA, 1865 bp, Homo sapiens
  Payload ID: 13043
  Gene Symbol: KCTD4
  Gene Name: potassium channel tetramerization domain containing 4
  Uniprot ID: Q8WVF5
  ENST ID: ENST00000379108
  CDS Start-End: 151-930
gcaaaaccgagctgacagcgcaggcgatgctgccagcgtttccattccatcaccaggctggggctgaataaaggcgtgcttgtgtggtagtgtctctttttaaaaaatctcaaagccaagaagaacaagctgaaatagcatcttcaaaaaatggagcgtaaaataaacagaagagaaaaagaaaaggagtatgaagggaaacacaacagcctggaagatactgatcaaggaaagaactgcaaatccacactgatgaccctcaacgttggtggatatttatacattactcaaaaacaaacactgaccaagtacccagacactttccttgaaggtatagtaaatggaaaaatcctctgcccgtttgatgctgatggtcattatttcatagacagggatggtctcctcttcaggcatgtcctaaacttcctacgaaatggagaacttctattgcccgaagggtttcgagaaaatcaacttcttgcacaagaagcagaattctttcagctcaagggactggcagaggaagtgaaatccaggtgggagaaagaacagctaacacccagagagactactttcttggaaataacagataaccacgatcgttcacaaggattaagaatcttctgtaatgctcctgatttcatatcaaaaataaagtctcgcattgttctggtgtccaaaagcaggctggatggatttccagaggagttttcaatatcgtcaaatatcatccaatttaaatacttcataaagtctgaaaatggcactcgacttgtactaaaggaagacaacacctttgtctgtaccttggaaactcttaagtttgaggctatcatgatggctttaaagtgtggctttagactgctgaccagcctggattgttccaaagggtcaattgttcacagcgatgcacttcattttatcaagtaattacctgtgtcacgaacaaaggcaacaagcatgcagccagcaagcttcggaaaaccacagcatcaaagacatcccaaataacatgcccagctagctctgtactacagagccctgctactaatcaattactgtgagctaacggtatgtaaattctatcgctaaagatgtccttcctctggggtgttcctactgatcagactcttccacctaaaatgaaaacagtaaccttctatatactgtaaataaagactgaaagcttttgctatttatttgtccttaagctgtctttcaattcagattgtcttgggtatttgcacaaaaaagaaagcatgtacattatctatcgttcatttaagtaaatggtaataaaatattttaaggggctattaatatttaaaatccttttctactatggcaaaaatctacagagaaactgaactggcaaaattaactacctggagcaaaacagatgtgcagatctaactaaaacagagctatagtgaaacaaaatgagattgtaagaagacattaaagctattgatttgatttttccatagcaagcaccaaaagcttatattcacagttcctgtgtttcatattagacttatagctgaattggtattttgctgaaaattcctagaaaactgcttgatgacaataaaaagtaaataaaagcactgctaccttctttgattgtattaatgattataataaaaagttacaggtcactttaaaagcaaacagtaccacttgatgattttgcataaaattatgcattgatgtcaaccggcaggctacaggaaccctggctggtcctggaagtgacaaaaaccagcaaattcaattctttgcaggctgagttcccacaaagcatgggtaacttagtctcaatagagtatctgttattagaataataaaggagttcattttcagaa

SEQ ID NO: 168000 - DNA, 2482 bp, Homo sapiens
  Payload ID: 13044
  Gene Symbol: KCTD5
  Gene Name: potassium channel tetramerization domain containing 5
  Uniprot ID: Q9NXV2
  ENST ID: ENST00000301738
  CDS Start-End: 75-779
acagaactcagaggacgctattaaaagccggacgcttccggtggaagggagctgttgcggggcttgctgggatcatggcggagaatcactgcgagctcctgtcgccggcccggggcggcatcggggcggggctggggggcggcctgtgccgccgctgcagcgctgggctcggcgccctggcccagcgccctggcagcgtgtccaagtgggtccgactcaacgtcggcggcacctacttcctcaccactcggcagaccctgtgccgggacccgaaatccttcctgtaccgcttatgccaggccgatcccgacctggactcagacaaggatgaaacaggcgcctatttaatcgacagagaccccacctactttgggcctgtgctgaactacctgagacacggcaagctggtgattaacaaagacctcgcggaggaaggagtgttggaggaagcagaattttacaatatcacctcattaataaaacttgtaaaggacaaaattagagaacgagacagcaaaacatcgcaggtgcctgtgaagcatgtgtaccgtgtgctgcagtgccaggaggaggagctcacgcagatggtgtccaccatgtccgacggctggaagttcgagcagttggtcagcatcggctcctcttacaactatgggaacgaagaccaagccgagttcctctgtgtggtgtccaaggagctgcacaacaccccgtacggtacggccagcgagcccagcgagaaggccaagattttgcaagaacgaggctcaaggatgtgagggacacagtattgacagctgaagaaatgatttacgttttcccgagatgtaatgaactgccatgtccaggaagcttggctgtgagaagaaacctgcttttgatcatttttctagagatctgggtgtgaatccttttttgcctctgaggtgggtggtgagagacgggcccagctgtccaaggccagacgtccccaagttgggggagcacggcggccgggtgggcgctgcctcttgggggggcctcgctctgttttttccaagtgccacgtgggactgaggcagacactcccagtcagcccgctcgatcctgaagatcgtgtgaaggaagcgttcttggtgctacacacagtctggaaaagcagcctgggcttcactggcaggaagcggccgcagccgcgtcagtgtccagcacgtcgtggcctctggtccgaccaccaggccctagtctcggtcagggagtctgctctgcctcccaggcgggatcgctggtttctctcgacctcgcagagctcctgacaaaggcggcttctgcgtcgtcactgcttcccggcgccattccgaggccgggccttcttctgacacgggctccaaccccacctgaccaagcccgggacagtcaaggcttctcaatttgtattttccaggcaagagaactttgtaccccttctctgtgtggatagactccccagcgtttttcctctggaaatgcccacagggcttgccgcgtggagactgatctgttccatccgttagcgcgaggtagcagtgtcgcctcgcccctcccactgcgggctcacggggagctggcgtctgtcagtgccttgtcacgcctggcatagaggttgggctggaggcctgtccactggcttctggagctgaaggtctgcgtcacggtgaaaattcgggatgtttacagagcatcacaaatgcctctctctcgccgctctctcattttctttgtataactatgcagccttccctctctttctgggatgtttgggacttcactcgacctgcacgggctctgcccgacatgccgtgggagctgctgggattcctttagaaaccgctgcccgcatgctttgaaaacagacctttctcagctggctgtggggacctgtcagagtctggggactcggcgtgcagggcgggctccaagcgctttgcttccggaactccggcttcccaaggggtactgtgcagactgaccaccggcctcccgcctgcaggtcagaggctctgacactgtctggtttccaatgcttctggagacttcctgcctaggcctcatcctcctctttgccagtcacctgattaaccaattctccagcattaggacttacctccttctttttgtaaggtctcttgtatgttgttaaatgtttggcttaaacaatttataaaagcctttctagaaggcagacttagccccagcagagcctgggaggaaggcggccgctggggctcctgggcatcctctctggggagctgctggccgcttagcgttgtttgatttttgaccttgacatagtagataggcttgtggtttttttaatttaaagatattaagacttaattcactaaaatttattctaaggggatatttatacttttatacttttttaggtatcgtattttatcagcttacagtttaatgcctaagtttcccctggaaatagcaaataaaattgtgtatttatgaa

SEQ ID NO: 168001 - DNA, 774 bp, Homo sapiens
  Payload ID: 13044
  Gene Symbol: KCTD5
  Gene Name: potassium channel tetramerization domain containing 5
  ENST ID: ENST00000564195
  CDS Start-End: 10-750
gctgggatcatggcggagaatcactgcgagctcctgtcgccggcccggggcggcatcggggcggggctggggggcggcctgtgccgccgctgcagcgctgggctcggcgccctggcccagcgccctggcagcgtgtccaagtgggtccgactcaacgtcggcggcacctacttcctcaccactcggcagaccctgtgccgggacccgaaatccttcctgtaccgcttatgccaggccgatcccgacctggactcagacaaggatgaaacaggcgcctatttaatcgacagagaccccacctactttgggcctgtgctgaactacctgagacacggcaagctggtgattaacaaagacctcgcggaggaaggtgcctgtgaagcatgtgtaccgtgtgctgcagtgccaggaggaggagctcacgcagatggtgtccaccatgtccgacggctggaagttcgagcagttggtcagcatcggctcctcttacaactatgggaacgaagaccaagccgagttcctctgtgtggtgtccaaggagctgcacaacaccccgtacggtacggccagcgagcccagcgagaaggccaagattttgcaagaacgaggctcaaggatgtgagggacacagtattgacagctgaagaaatgatttacgttttcccgagatgtaatgaactgccatgtccaggaagcttggctgtgagaagaaacctgcttttgatcatttttctagagatctgggtgtgaatccttttttgcctctgaggtggg

SEQ ID NO: 168002 - DNA, 2425 bp, Homo sapiens
  Payload ID: 13045
  Gene Symbol: KCTD6
  Gene Name: potassium channel tetramerization domain containing 6
  Uniprot ID: Q8NC69
  ENST ID: ENST00000355076
  CDS Start-End: 984-1697
tgtacaaagagaaatacatcattatttaaaagcatcatcttttttttttatattgtaagataaataccattctgatgtatttctcttggaaagggatgctggtatcctgggaggtttatgatttttgatgtttttactcaggtgattggcttgtatagctgaaatgctgatgaaaaggagttttcccttctccctttttcttttcttttctttttttttttttttttgagatggagtctcgcactgttgcaggggctggtgtgcagtggcacagtctcggctcactgcaacctccgcctctcgggttcaagtgatgctcctgcctcagcctcctgaatagctaggattacaggtgcccaccaccacgcccagctaattttttgtatttttagtagagatggggtttcactatgttgggcagtctggtcttgaactcctgacctggtgatcctcctgcctcagcctcccaaagtgctgggattataggcatgagccactgcgcccagcctgtccctttttcttaaatgacctttttggtgaggaccattataggtttgtaccaggataaggttgtagagttaatcataatattctcttatataaattctaaaaattgatgttctaagaagagaggtagaatttgaatgactgggttacttcctagactcttcctccttctcttaagtacagtatagttctttctctgaaaatcttcagtctcttagttccagatgggttctctatggtaagaatacaggacatgtagaaggccctaggggaatgctttcttccccagatctttgccctgtagtaggtttcagctgagcaaggacgagtagtttttctggtgtttggcctcctctgttgggtggaaaaagactttcttctctattttcctagttatatatgctatcatatgtctgtttttctcctcttgaagtttccctgaaacctgggctcttgaagacgcatcactggagcagatggataatggagactggggctatatgatgactgacccagtcacattaaatgtaggtggacacttgtatacaacgtctctcaccacattgacgcgttacccggattccatgcttggagctatgtttgggggggacttccccacagctcgagaccctcaaggcaattactttattgatcgagatggacctcttttccgatatgtcctcaacttcttaagaacttcagaattgaccttaccgttggattttaaggaatttgatctgcttcggaaagaagcagatttttaccagattgagcccttgattcagtgtctcaatgatcctaagcctttgtatcccatggatacttttgaagaagttgtggagctgtctagtactcggaagctttctaagtactccaacccagtggctgtcatcataacgcaactaaccatcaccactaaggtccattccttactagaaggcatctcaaattattttaccaagtggaataagcacatgatggacaccagagactgccaggtttcctttacttttggaccctgtgattatcaccaggaagtttctcttagggtccacctgatggaatacattacaaaacaaggtttcacgatccgcaacacccgggtgcatcacatgagtgagcgggccaatgaaaacacagtggagcacaactggactttctgtaggctagcccggaagacagacgactgatctccgaccctgccacaggttcctggaaagactctccaggaaatggaagatactgatttttttttttaaatcacagtgtgagatattttttttcttttaaatagttgtatttatttgaaggcagtgaggaccagaaggaagttttgtgctttggcagactcctccatgttttgttcccttccccctgagtatgcatgtgcctgttcagagtctccagataccttttttataaaaagaagtctgaaaatcattatggtatataatctacccttaacagagcttttcttattacagtgctaaaatgatttctgataaaatggtccctaactcaactagaaggctaaaaatacaagaatgaaagaataagcagagtactcatgatgcctttgagaaaaatcaaaacatcatgtagggtgacctagtttccaaaccaataaataagtagtattgtaatattaaaggaaaactgttccaatcatttaaaagtacttattaagtactgctttttacagttatgacaactgtttctttctatgcatataaatcaaggaaccaaatatctgtagccatggaaatgtctgactagaaatatttatattgaattctgaatacaaaatgtccctgtggtagaaaacttactctttatgcctggtgcagtataattcccaagtgtactgtctaccagaaaaaaaaaacaaaactaataaaaaatgaaatatgaaaattaa

SEQ ID NO: 168003 - DNA, 1533 bp, Homo sapiens
  Payload ID: 13045
  Gene Symbol: KCTD6
  Gene Name: potassium channel tetramerization domain containing 6
  Uniprot ID: Q8NC69
  ENST ID: ENST00000404589
  CDS Start-End: 100-813
gctctccggccgcgggcatctcccggcccggccgcagcagccgccgccgccgcgcatttccctgaaacctgggctcttgaagacgcatcactggagcagatggataatggagactggggctatatgatgactgacccagtcacattaaatgtaggtggacacttgtatacaacgtctctcaccacattgacgcgttacccggattccatgcttggagctatgtttgggggggacttccccacagctcgagaccctcaaggcaattactttattgatcgagatggacctcttttccgatatgtcctcaacttcttaagaacttcagaattgaccttaccgttggattttaaggaatttgatctgcttcggaaagaagcagatttttaccagattgagcccttgattcagtgtctcaatgatcctaagcctttgtatcccatggatacttttgaagaagttgtggagctgtctagtactcggaagctttctaagtactccaacccagtggctgtcatcataacgcaactaaccatcaccactaaggtccattccttactagaaggcatctcaaattattttaccaagtggaataagcacatgatggacaccagagactgccaggtttcctttacttttggaccctgtgattatcaccaggaagtttctcttagggtccacctgatggaatacattacaaaacaaggtttcacgatccgcaacacccgggtgcatcacatgagtgagcgggccaatgaaaacacagtggagcacaactggactttctgtaggctagcccggaagacagacgactgatctccgaccctgccacaggttcctggaaagactctccaggaaatggaagatactgatttttttttttaaatcacagtgtgagatattttttttcttttaaatagttgtatttatttgaaggcagtgaggaccagaaggaagttttgtgctttggcagactcctccatgttttgttcccttccccctgagtatgcatgtgcctgttcagagtctccagataccttttttataaaaagaagtctgaaaatcattatggtatataatctacccttaacagagcttttcttattacagtgctaaaatgatttctgataaaatggtccctaactcaactagaaggctaaaaatacaagaatgaaagaataagcagagtactcatgatgcctttgagaaaaatcaaaacatcatgtagggtgacctagtttccaaaccaataaataagtagtattgtaatattaaaggaaaactgttccaatcatttaaaagtacttattaagtactgctttttacagttatgacaactgtttctttctatgcatataaatcaaggaaccaaatatctgtagccatggaaatgtctgactagaaatatttatattgaattctgaatacaaaatgtccctgtggtagaaaacttactctttatgcctggtgcagtataattcccaagtgtactgtctaccagaaaaaaaaaacaaaactaataaaaaatgaaatatg

SEQ ID NO: 168004 - DNA, 1759 bp, Homo sapiens
  Payload ID: 13045
  Gene Symbol: KCTD6
  Gene Name: potassium channel tetramerization domain containing 6
  Uniprot ID: Q8NC69
  ENST ID: ENST00000490264
  CDS Start-End: 351-1064
ccggccgcgggcatctcccggcccggccgcagcagccgccgccgccgcgcaaccacatggttgagaaaggagaaagagaaaatgattacttgtagagaaaaatccatttctgcagtggtatggttaaggataatctaaccataatcacattatccttgtatgcctggctacttatgctggcctgtatgtgaatgttaaccccaaagactcctttagatgtcgctgaactagttactataaaaagtatttcgctttcaaactcccacatttcaagaagagcaaaactcaatacaaggcaattttgaagtttccctgaaacctgggctcttgaagacgcatcactggagcagatggataatggagactggggctatatgatgactgacccagtcacattaaatgtaggtggacacttgtatacaacgtctctcaccacattgacgcgttacccggattccatgcttggagctatgtttgggggggacttccccacagctcgagaccctcaaggcaattactttattgatcgagatggacctcttttccgatatgtcctcaacttcttaagaacttcagaattgaccttaccgttggattttaaggaatttgatctgcttcggaaagaagcagatttttaccagattgagcccttgattcagtgtctcaatgatcctaagcctttgtatcccatggatacttttgaagaagttgtggagctgtctagtactcggaagctttctaagtactccaacccagtggctgtcatcataacgcaactaaccatcaccactaaggtccattccttactagaaggcatctcaaattattttaccaagtggaataagcacatgatggacaccagagactgccaggtttcctttacttttggaccctgtgattatcaccaggaagtttctcttagggtccacctgatggaatacattacaaaacaaggtttcacgatccgcaacacccgggtgcatcacatgagtgagcgggccaatgaaaacacagtggagcacaactggactttctgtaggctagcccggaagacagacgactgatctccgaccctgccacaggttcctggaaagactctccaggaaatggaagatactgatttttttttttaaatcacagtgtgagatattttttttcttttaaatagttgtatttatttgaaggcagtgaggaccagaaggaagttttgtgctttggcagactcctccatgttttgttcccttccccctgagtatgcatgtgcctgttcagagtctccagataccttttttataaaaagaagtctgaaaatcattatggtatataatctacccttaacagagcttttcttattacagtgctaaaatgatttctgataaaatggtccctaactcaactagaaggctaaaaatacaagaatgaaagaataagcagagtactcatgatgcctttgagaaaaatcaaaacatcatgtagggtgacctagtttccaaaccaataaataagtagtattgtaatattaaaggaaaactgttccaatcatttaaaagtacttattaagtactgctttttacagttatgacaactgtttctttctatgcatataaatcaaggaaccaaatatctgtagccatggaaatgtctgactagaaatatttatattgaattctgaatacaaaatgtccctgtggtagaaaacttactctttatgcctggtgcagtataattcccaagtgtactgtctaccagaaaaaaaaaa

SEQ ID NO: 168005 - DNA, 564 bp, Homo sapiens
  Payload ID: 13045
  Gene Symbol: KCTD6
  Gene Name: potassium channel tetramerization domain containing 6
  ENST ID: ENST00000479179
  CDS Start-End: 538-564
ctacaggacctccctgggaacctgttctctttccttgtcctgatgtgttactcttataggccaatttttgcctttgtgttgtgcctaaatggtgtaattaccccgttttgggaaggtggtattatcccgttttatcttgcggaaactgagggttaagaggaatgttatgattttgtgactatttgtgacagctttttaatattaggtcacttttaaacctatagcttctctcttctagaccacatggttgagaaaggagaaagagaaaatgattacttgtagagaaaaatccatttctgcagtggtatggttaaggataatctaaccataatcacattatccttgtatgcctggctacttatgctggcctgtatgtgaatgttaaccccaaagactcctttagatgtcgctgaactagttactataaaaagtatttcgctttcaaactcccacatttcaagaagagcaaaactcaatacaaggcaattttgaagtttccctgaaacctgggctcttgaagacgcatcactggagcagatggataatggagactggggctatatg

SEQ ID NO: 168006 - DNA, 408 bp, Homo sapiens
  Payload ID: 13045
  Gene Symbol: KCTD6
  Gene Name: potassium channel tetramerization domain containing 6
  ENST ID: ENST00000491093
  CDS Start-End: 187-408
gcagcagccgccgccgccgcgcatttccctgaaacctgggctcttgaagacgcatcactggagcagatggataatggagactggggctatatgagatggggtcttgccatgttgcccaggctggtcttgaactcctgagctcaggcaatctgcctgccccggcctcccaaagtgctaggattacagatgactgacccagtcacattaaatgtaggtggacacttgtatacaacgtctctcaccacattgacgcgttacccggattccatgcttggagctatgtttgggggggacttccccacagctcgagaccctcaaggcaattactttattgatcgagatggacctcttttccgatatgtcctcaacttcttaagaacttcagaattgaccttaccgttggatttt

SEQ ID NO: 168007 - DNA, 4873 bp, Homo sapiens
  Payload ID: 13046
  Gene Symbol: KCTD7
  Gene Name: potassium channel tetramerization domain containing 7
  Uniprot ID: Q96MP8
  ENST ID: ENST00000275532
  CDS Start-End: 185-1054
agctgggcgcgagcgggtcggcgttgagggagccaccgccctcccgcctgcgcactgcctctcgcccccctccggccagcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggagtttcctgaggttgttccccttaacatcggaggggctcacttcactacacgcctgtccacactgcggtgctacgaagacaccatgttggcagccatgttcagtgggcggcactacatccccacggactccgagggccggtacttcatcgaccgagatggcacacactttggagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtggtgagtagccccggtaggcgagagtcccatcagggaggatgtccaccttgcttggtggctctgggagtaagatccctgaaggggctgctgactgccccagaatctgccgaggtgagaacagcatcctgaggcacagctcccaggggacagaggtgtagctccaatctccctgactgcacctcagggttgggctcagggcttgcggcctgcaggcactccagccagcgctcacctggcctttcctcaaggcatggtagtctttccttgaggctgatagctagggcttgaccaggaagtcccgagaagttttgtcaccttcttgaccttgcaagagagtttctgcccattttagagccacgttaccaaatcgatgtaggcctaatcacttcctcaaccctgttcaagcgtccctcccttgtgctcagtatattggtgtgaacacggaacatgatgggggatttacctgaccagccaccccatagcccctggctgaagaagaaagagcatcttctctcccactgcaccccttctcctccaagaatagttgcccacattcccaaaatgtggaaagacttttcttttccttccggaacatgttcttcaccaccttttggagatttaaccatagctgccaaagctatgcacccagttggccttagaaaaccacaatgtttacagccctgtcttagggccgcggcttctcttatcttccaccaccttccttgcttgcagggttatcttctcacagggctggaatgcaaatttcagaggcttcttttgaagattccccaagtcaagcaggcaagatgcctagatcttctgttatctttgacatgtaacatcctttttagaggctcagaacacctccttggctgctatctcatgtgttagaatccagtttgtggtgaacctctttggaaggggaccccctctctttaaaccctgttcctctgtcctggtaacattctccttctaggagagcctctcttctgagaaggtaaaggaagggctgggtgagacacacagctatcctaggagccgtaggaagacaaaacttcccttttgttttactcctcactcctctatttttgttttactcacttctttatattttgttttactcctcactcctgtatattttggtttacttactcctctatttcagaaattgaaaaagatccccaaggatctgttactactgcatttccttcttgctctgtctacagcctaggccaactagtcagggtctggacatgcatctcctaaaggaagaactgtgtagcaccattgatcacaatgtaacatttccatgctgcattaagggtgtctctctctaatcatgattgtacctgtctcttcctgggtaaagggagatttttttttttaatgtgtaaagaattgatgcgagccaggaacatgtctgtagtcccagctacttgggcacacgcctgtagtccaggccactcgagcacacacctgtagtaccagctactctggaggctgaggcaggaggatcacttgagcccaggagattaagactgtagtatactatgatcgtgcctgtggctagccactgtgctccagcctgggcaacaccatcgtaaaaataaataaataaataaataaattggggaggacagcctcactggtatcagacttacaggaccagatagacaagatgggtataaggggagctgaagtctgtgttcatatgaggaagagaagaccaagccctgggactttggctgaattcctccgtggggctggacggcagtgatctcctgttccctatgtgtaaacaaagattccagggcgtggttttgcactcctgttgtactcttttagaggtggaaaagaggtggatactgagatctaagaggaaaggatagtcattcacgttctgagatatgcgctctctctattgttctcgtacacaaagggatagtctcttttctggagctgatgtccctgcttggaggttagccccaaaacatggctcttgtattgttctaagagaaaaggctttcattttggttcttctgattggtgttacctactgcctaatatgtgttcattttttgacagagaggcagactattgaaaaagtctgtgtgaacagagagcagttcattaagcccattgctttcagtaatgtggccttgaccccttctgcttcccccttctcccatggagcatggcagggcttggttatttagagtccatacatgcaagccattgagagacttgtttgctcaaatgcaagtttgctcaaaaacaggtcctgaaggcttgcttaggattacagggatgctgggtaagaacaccgttcctctctctcgctggagaaatccctgtttctctgactccctttgtgatcctcacagtaatgtattctgtgccactgtaggacacaaggctctgggccagtagaacaggcagagaggtgacactgggcagcaagctgagagctctttctaaatggagtgaaggaattcagtggcctagtttcgccattctctaatgagaaaccaaggccaggctgaaaagtgcaattagatgtggtggattgtggtaacggcctccagataaaggggttatccctgtggaagtgacttttccccatttgatcccttttcaactctaaatggccaggcccagaacagaagaagggttgggtctggaaggaaggctccaaaggatgaaagcttctccctgatcataaggaagtgcatctttatagaattgttgtgcataatgtcagtaaatccctctcacttgacaagggactggattcatcttgccttgagacgggccagtagttatcagtgagtcaaagcaaagtgaaagtttcaggagatgggaccaatggtgcaatgctcgccataacaaaattccttaaaaataaaaaagctaatgttatagcaacaaaaaaagactgaagcaaaaccacactgaaatgcatcccactccaggagaggaattcttagcgtaacactctaaataaatggaaggaatcatcaccttccttattttacctctgccttgttcaccaggctgcccagtgcttaccatgcagaaagcagtcagctgtactctggaagtttctgttcttctttcctggggcttaggatattctgggagctgtctgagccttgtgcctaaggcttatcaggtgatataatcttcctgttctgggctgcttgctggaggaataggaagtgacatttataagacacaggcggtgtgagcatccatgtgtggtcttggtctaaaccagctcttgaacaggttaaagcaaacagcaataacaaaacaaaaactactgatgctgagcgttttgatcctagtaatatttcaaatattgtccttctgcatatgttctatccatatttgattccaatatacattattaagctttcttgggtactattttgctggggctcttgcgtgaaggtggtacctgtctcatgatccttaaaagagagaggcttttttcatccaaagctgtagtgttgggaactggggtgggagaggcactttttggaattctgaaagaatcatatctgtgtatatacatactgagtggggaaggatgggggttggcaggggttgagggaggtgggaacaaacagtgagtatgggaacaggcagtcacctcgagtgtgggaggtcacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaacctg

SEQ ID NO: 168008 - DNA, 504 bp, Homo sapiens
  Payload ID: 13046
  Gene Symbol: KCTD7
  Gene Name: potassium channel tetramerization domain containing 7
  ENST ID: ENST00000449064
  CDS Start-End: 108-504
agcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggagagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaagaccacttggagcggattgtggagatcgcccggctgcgtgcggtccagcggaaggcccgctttgccaagctcaag

SEQ ID NO: 168009 - DNA, 1160 bp, Homo sapiens
  Payload ID: 13046
  Gene Symbol: KCTD7
  Gene Name: potassium channel tetramerization domain containing 7
  Uniprot ID: Q96MP8
  ENST ID: ENST00000443322
  CDS Start-End: 123-989
cgcccccctccggccagcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggagtttcctgaggttgttccccttaacatcggaggggctcacttcactacacgcctgtccacactgcggtgctacgaagacaccatgttggcagccatgttcagtgggcggcactacatccccacggactccgagggccggtacttcatcgaccgagatggcacacactttggagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtgaaattgaaaaagatccccaaggatctgttactactgcatttccttcttgctctgtctacagcctaggccaactagtcagggtctggacatgcatctcctaaaggaagaactgtgtagcaccattgatcacaatgtaacatttccatgctgcattaagggtgtctctctctaa

SEQ ID NO: 168010 - DNA, 4137 bp, Homo sapiens
  Payload ID: 13046
  Gene Symbol: KCTD7
  Gene Name: potassium channel tetramerization domain containing 7
  ENST ID: ENST00000503687
  CDS Start-End: 108-806
agcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggagagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaagaccacttggagcggattgtggagatcgcccggctgcgtgcggtccagcggaaggcccgctttgccaagctcaagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgggtcttgctctgttaccctggctggagtgcaatggtgcaatttcaacttactgcaacctctgcttcctgggctcaagtgatcctcctgcttcagcctcccaagtagctaggactacagaaactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagagaggagatttcaccatgttggccaggctggtcttgaactcctgacctcaggcgatccacctgcctcagcctcccaaagtgctgggaatacaggagtagagccaccgcacccagctgtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttccc

SEQ ID NO: 168011 - DNA, 2587 bp, Homo sapiens
  Payload ID: 13047
  Gene Symbol: KCTD8
  Gene Name: potassium channel tetramerization domain containing 8
  Uniprot ID: Q6ZWB6
  ENST ID: ENST00000360029
  CDS Start-End: 285-1706
acttccccgccctcgccccaaaggagcagcagctccttcttgcctctccattgccgccgccgcaccggcggagctcctctctcgcgcgtctctcctccgatggagctcgggcgccgccgacgccgccgctgccccgaaccctgagcggggccgccccggtcggaggaacgcgccgcccagtccgagggcgcagagcgccaggagcacgcggagggctggggcgcgggctccgggaacgagaaagtgcagctctctcgggtcactgggccggcggcggggggactatggctctgaaggacacgggcagcggcggcagcaccatcctgcccattagcgagatggtttcctcgtccagctcgcccggcgcgtcggccgccgccgccccggggccctgcgcaccctcgcccttccctgaagtagtggagctgaacgtaggcggccaggtttatgtgaccaagcactcgacgctgctcagcgtcccggacagtactttggccagcatgttctcgccctctagtccccgtggcggcgcccggcgccggggcgagctgcccagggacagccgggcgcgcttcttcatcgaccgggacggcttccttttcaggtacgtgctggattatctgcgggacaagcaactcgcgctgccggagcacttccccgagaaggagcggctgctgcgcgaggccgagtatttccagctcaccgacttggtcaagctgctgtcgcccaaggtcaccaagcagaactctctcaacgacgagggctgccagagcgacctggaggacaacgtctcgcagggtagcagcgacgcgctgctgctgcgcggggcggcggccgccgtgccctcgggcccgggagcgcacggtggtggcggcggcggcggcgcgcaggacaagcgctcgggcttcctcacgctgggctaccggggctcctacaccaccgtgcgcgacaaccaggccgacgccaaattccggcgtgtggcgcgcatcatggtgtgcgggcgcatcgcgctggccaaggaggtcttcggggacacgctcaacgagagccgcgaccccgaccggcagccggagaagtacacgtcccgcttctacctcaagttcacctacttggagcaggcctttgatcgcctgtccgaggccggcttccacatggtggcgtgtaactcctcgggcaccgccgccttcgtcaaccagtaccgcgacgacaagatctggagcagctacaccgagtacattttcttccgaccacctcagaaaatagtatcacctaaacaagaacatgaagataggaaacatgacaaagtcactgataaaggaagtgaaagtgggacttcctgtaatgagctctccacttccagttgtgacagccattcagaggcaagcactccccaggacaacccatccagtgcccagcaggcaacagctcaccaacctaacactttaacattggatcgcccctctaaaaaagcacctgtacaatggatacccccaccagacaaacgcagaaacagtgaactctttcagaccctcatcagcaagtcccgggaaacaaatctgtccaaaaagaaagtctgtgagaagctaagtgtggaagaagaaatgaaaaagtgtattcaggattttaaaaaaatccacattccagattattttccagagcgcaaacgccaatggcaatctgaactgttgcagaagtatgggttatagtaattgtcacattcctgcagtattttgatgacattcaatgtttactacagtgtcaccacctgactgatgtcctaacaatggtcagtgtgattcttgctgctcttccttgttgtgaacagtggatgtgggacagtattttcttttatgttttagttgttgttctttttagaaacatgattaaaaaggaaaaaatattaaatcaataagtgttaaatcaaaatggaatatctgattcaaaccattttacaagaatgaaagtaaaatgtgcatgatcaagcttagtatcttggtttttgaactctggtcaactggatatgtttgtcattttgtaacttaccaaaaacaaaccatcatatcataccaactaaaatgatatatggatgaagcaacatcaagtaaaattttagacgatggctataggacccaaatctaaagctgtctaaatgttaattcaatgaaacaagtattatttttgcatgaatacaatgttacaaataaatcacaagaaatagggaagatctgtttgttgcttggaaagaaaaaaattacaaaaaaaagcaaaaaaaaatgttttagacaaagcctataaatgtaagctgtctaggagattgaattttctttgttctggatctgtgacttttttgtgtatgtgtatggtgtttatgtatattaagatggtgtaaatatgccttatactgttatttatggcatcaacattcatttactaatgctagtcatgattattactgtgaaatgagtcttacatcgggctgtgaaaattggtataatgatgctttgaaagatcctattatcatgttaatcaaaataatagagggaaatggtaaagagctttatgtatttattaaaaaaagaaaaatgta

SEQ ID NO: 168012 - DNA, 464 bp, Homo sapiens
  Payload ID: 13047
  Gene Symbol: KCTD8
  Gene Name: potassium channel tetramerization domain containing 8
  ENST ID: ENST00000515268
  CDS Start-End: 1-464
agtaccgcgacgacaagatctggagcagctacaccgagtacattttcttccgttctctgacgatgtctttgtgctcaatcttacgtttgaatatatggctatttatgattgcttgccagatcaagcatgaatcaagatgcagaaccagggccagatgcttggcagcaggaccacctcagaaaatagtatcacctaaacaagaacatgaagataggaaacatgacaaagtcactgataaaggaagtgaaagtgggacttcctgtaatgagctctccacttccagttgtgacagccattcagaggcaagcactccccaggacaacccatccagtgcccagcaggcaacagctcaccaacctaacactttaacattggatcgcccctctaaaaaagcacctgtacaatggatacccccaccagacaaacgcagaaacagtgaactctttcagaccctcatcagcaag

SEQ ID NO: 168013 - DNA, 3401 bp, Homo sapiens
  Payload ID: 13048
  Gene Symbol: KCTD9
  Gene Name: potassium channel tetramerization domain containing 9
  Uniprot ID: Q7L273
  ENST ID: ENST00000221200
  CDS Start-End: 222-1391
ggcaggctgaggagcctaggggcggggtgggaaggaggaccggccgaaccttgggtgtgggacagagtgcgtgcgtgtggtgtgtccccaagggcaggaaggtggcgaagggaggcgaatccgagtgggtggagggaggggaagggcgggaggagaaaaaggtgggaggaggaccaggtgggagggtggcggctcactcaggacccagcgggggcagcgcgatgaggcgggtgaccctgttcctgaacggcagccccaagaacggaaaggtggttgctgtatatggaactttatctgatttgctttctgtggccagcagtaaactcggcataaaagccaccagtgtgtataatgggaaaggtggactgattgatgatattgctttgatcagggatgatgatgttttgtttgtttgtgaaggagagccatttattgatcctcagacagattctaagcctcctgagggattgttaggattccacacagactggctgacattaaatgttggagggcggtactttacaactacacggagcactttagtgaataaagaacctgacagtatgctggcccacatgtttaaggacaaaggtgtctggggaaataagcaagatcatagaggagctttcttaattgaccgaagtcctgagtacttcgaacccattttgaactacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgactgtgcgaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttctcagaatttcattctaggcaagttccactcaacaccagatcaagcaattctatctatttacactattagcctagttttctcatacagtcatcacaagcataggaagatacttcaaaaccaaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggggaatgaggaattttaaacacacatttgattacagccaccaaaaaaatagacgtaaaaataaaggcatttggctggtccaagatgtaattatcaatcagtcagcacctgtgattcttttacttatttttttgtggttttttttttttaaacaaattttagcccaattttcttgagtcattctctctctgcagcagcagaggaagggcctgtacctccctaccaatgacttggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttattatttttaccaagacagagaagtattgtattgagagataatctattttcataatcaatatgtgcctaaattatatttaaatcatttcactctgtactatattttcaggaattacagaatgtggtattcattcacttaaaggtacctctgtagaaataacctaaaactgcagaaggatctgaaagatctaaacatggtgtgcttagaaactgcagattttagatctaatgtatactgcattaataaatgatataaagtgtttgttgaaaaggagtttcttctcttccttttgaaaatcatcactttctgtattttgcttacatttcttcaatatgtgttgacaaccagccctgtggttctgggtagcaaaggaaatacagtataacttaatttgttatggattagtctttttgaaagtaccattaaagtaaatttatttctttaaa

SEQ ID NO: 168014 - DNA, 2128 bp, Homo sapiens
  Payload ID: 13048
  Gene Symbol: KCTD9
  Gene Name: potassium channel tetramerization domain containing 9
  ENST ID: ENST00000519665
  CDS Start-End: 231-404
agggccccaggcaggctgaggagcctaggggcggggtgggaaggaggaccggccgaaccttgggtgtgggacagagtgcgtgcgtgtggtgtgtccccaagggcaggaaggtggcgaagggaggcgaatccgagtgggtggagggaggggaagggcgggaggagaaaaaggtgggaggaggaccaggtgggagggtggcggctcactcaggacccagcgggggcagcgcgatgaggcgggtgaccctgttcctgaacggcagccccaagaacggaaaggtggttgctgtatatggaactttatctgatttgctttctgtggccagcagtaaactcggcataaaagccaccagtgtgtataatgggaaaggtggactgattgatgatattgctttgatcaggtaaccttcacctttttataagctgtcaacagtgtgcctcaacttcttgatcctcagacagattctaagcctcctgagggattgttaggattccacacagactggctgacattaaatgttggagggcggtactttacaactacacgcgttactcctaccaggttgtagcatgcatctttttgagagagcagctgggatcgagtatactcttgacttaaatatgtttgtttataaagacaaatggagaaatcaatttttttccctgaattcttaggagcactttagtgaataaagaacctgacagtatgctggcccacatgtttaaggacaaaggtgtctggggaaataagcaagatcatagaggagctttcttaattgaccgaagtcctgagtacttcgaacccattttgaactacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgactgtgcgaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggaca

SEQ ID NO: 168015 - DNA, 840 bp, Homo sapiens
  Payload ID: 13048
  Gene Symbol: KCTD9
  Gene Name: potassium channel tetramerization domain containing 9
  ENST ID: ENST00000523140
  CDS Start-End: 142-330
tgtgtccccaagggcaggaaggtggcgaagggaggcgaatccgagtgggtggagggaggggaagggcgggaggagaaaaaggtgggaggaggaccaggtgggagggtggcggctcactcaggacccagcgggggcagcgcgatgaggcgggtgaccctgttcctgaacggcagccccaagaacggaaaggtggttgctgtatatggaactttatctgatttgctttctgtggccagcagtaaactcggcataaaagccaccagtgtgtataatgggaaaggtggactgattgatgatattgctttgatcagatcctcagacagattctaagcctcctgagggattgttaggattccacacagactggctgacattaaatgttggagggcggtactttacaactacacggagcactttagtgaataaagaacctgacagtatgctggcccacatgtttaaggacaaaggtgtctggggaaataagcaagatcatagaggagctttcttaattgaccgaagtcctgagtacttcgaacccattttgaactacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctg

SEQ ID NO: 168016 - DNA, 3625 bp, Homo sapiens
  Payload ID: 13049
  Gene Symbol: KCNN1
  Gene Name: potassium channel, calcium activated intermediate/small conductance subfamily N alpha, member 1
  Uniprot ID: Q92952
  ENST ID: ENST00000222249
  CDS Start-End: 320-1951
gaggaacacggtggtctgagctggagccacgctttctgttggagggggcagctgaaggagaacagcaagacatatccggcggccctacggactcggagagctggagggaccccggagatctcaaagggacaggaaaggcagcagcagccaccctctctcccagtcaagtggtcaccagcaggactgaaggggacagcccctttgcagtggctcggcgaggagacccctgcaccctagggtcagtgcaggagcccagccgctgagccatgccgggccccgggcggcctgcagcgagcccaacccctgcacccaggtagtcatgaacagccacagctacaatggcagcgtggggcggccgctgggcagcgggccgggcgccctgggacgagaccctccggaccctgaggccggccaccccccacaacccccgcacagcccgggcctccaggtggtagtggccaagagtgagccagcccggccctcacccggcagcccccgggggcagccccaggaccaggacgatgacgaggatgatgaggaagatgaggccggcaggcagagagcctcggggaaaccctcaaatgtgggccaccgcctgggccaccggcgggcgctcttcgagaagcggaagcgcctcagcgactatgccctcattttcggcatgtttggcatcgtcgtcatggtgacggagaccgagctgtcctggggggtgtacaccaaggagtctctgtactcattcgcactcaaatgcctcatcagcctctccacggccatcctgctgggtctcgttgtcctctaccatgcccgggagatccagctgttcatggtggacaacggggctgatgactggcgcatcgccatgacctgcgagcgcgtgttcctcatctcgctagagctggcagtgtgcgccattcacccggtgcccggccactaccgcttcacgtggacggcgcggctggccttcacgtacgcgccctcggtggccgaggccgacgtggacgtgctgctgtccatccccatgttcctgcgcctctacctgctgggccgggtgatgctactgcacagcaaaatcttcacggacgcctcgagccgcagcatcggggccctcaacaagatcaccttcaacacgcgcttcgtcatgaagacactcatgaccatctgccccggcaccgtgctgctggtcttcagcatctcctcctggatcatcgcagcctggaccgtgcgcgtctgcgagaggtaccacgacaagcaggaagtgaccagcaacttcctgggggccatgtggctgatttccatcaccttcctctccattggctacggcgacatggtgccccacacctactgcgggaagggtgtgtgcctgctcactggcatcatgggagctggctgtaccgcgctcgtggtggctgtggtggctcggaagctggagctcaccaaggctgagaagcacgtgcacaacttcatgatggacactcagctcaccaagcgggtaaaaaacgccgctgctaacgttctcagggagacgtggctcatctacaaacataccaggctggtgaagaagccagaccaagcccgggttcggaaacaccagcgtaagttcctccaagccatccatcaggctcagaagctccggagtgtgaagatcgagcaagggaagctgaacgaccaggctaacacgcttaccgacctagccaagacccagaccgtcatgtacgaccttgtatcggagctgcacgctcagcacgaggagctggaggcccgcctggccaccctggaaagccgcttggatgcgctgggtgcctctctacaggccctgcctggcctcatcgcccaagccatacgcccacccccgcctcccctgcctcccaggcccggccccggcccccaagaccaggcagcccggagctccccctgccggtggacgcccgtggccccctcggactgcgggtgacggccctgcccgccaccagacccctaaatcttggccatcgtgtggccgccacctccgggaagccttgtacagtggcgcctcttggagttcaagaagccaacgctgagtcaggctgagtggactgaggcctgccccgcccagactgcccaggcagagggcagggctggaccatgggtgagggcaggggagcccggagcttcctctggtcacctggtcccccgactctccccaggcccccggtgggcatggagcagcccggggaggggtccgtgctggttctgaataaagcaggacccgcctagtggctgcctgtgtgcatggctggaaggcactggtgatgtcccaggaggtagacctccagccctgggtaccaagatgaatgtgggaatcagaaaaacctgttcccatcaccggcctagcctagaatcctagcctagaagccctctctccctctgggctggagctcagtgagggacaactctctagggacacctgtaccagccccacctggcgctgagatccctcagacagcatggcccagccctggccagaagcatcgctccccttcaaccaaccgcgttgatggacacccactgtgtgccaggccccagcggggcccatgggggaggtgacctgggtgaggaaggtcatttgggtttttgtgagatttgtattgagcacctgctgtctacagagaatgtgatgatgtcaattaccacactgattcctcatcagaacttgaccatggtgggatgggggggaaactgaggcccagagaggtgaatctacctacctgggaccacactgcgaggaaggatggtgcattcaaactggaaatcccctaggccaaagtaaagaaccggactggctgggcacagtggctcacacctgtaatcccagcactttgggagggtaaagcgggcggatcacctgaggtcaggagttcaagaccagcctgggcaacatggtgaaaccctgtctctactaaaaatataaaaattagctgggtgtggtggtgcacgcctgtaatcccagctacttgggaggctgaggcaggataatcgcttgaacccaggaggtggaggttgcagtgagaaaaaacctggacttggtggaagggactccatggaggagccatggggacgtcaggaggaggggttatttggtgacatccaggggtcagagagacccttcaggggtgggctacaggggagggttccagacacaagtagaatcagaaaggtccctggaggccatgggcttgggtgctgggagcaacaggcatttacttggcagatgctgagccctgggtggggcgaggaggcctggctcctggggagacgacgctgtgcatagccgaggagccccaggtcctggcagcctctgataaggccatccatcgcctggctcaacgagataactaggccgtggctggtgcatgaatgaccagcttgggcccacgcacgagaagggtatgaggaggtgctggtcagacccgggttcgagtcctgactctgccactgctgggtgactctgagcagtggctgcccctctggggccttggttgtttcatctgtaaaatggggtgacagtctatttaaccagaactccctaaaaagggccaggcaactggtaggtgctcaataaatgctccttcccgcctgagggatcaca

SEQ ID NO: 168017 - DNA, 499 bp, Homo sapiens
  Payload ID: 13049
  Gene Symbol: KCNN1
  Gene Name: potassium channel, calcium activated intermediate/small conductance subfamily N alpha, member 1
  ENST ID: ENST00000609922
  CDS Start-End: 26-499
gggcccgtggactgggcggcgggggatgcgcctgccgccgccgcccccggccccgccgcccccgggccccgcgcccgctcgctgctgcccgccccgtccgcgaccccggctccggctcccgactgggggtccgcggccgcgcgggaccctctcccctccagccttgtccgcccgctcgggccgagccccgcaggtcagtgcaggagcccagccgctgagccatgccgggccccgggcggcctgcagcgagcccaacccctgcacccaggtagtcatgaacagccacagctacaatggcagcgtggggcggccgctgggcagcgggccgggcgccctgggacgagaccctccggaccctgaggccggccaccccccacaacccccgcacagcccgggcctccaggtggtagtggccaagagtgagccagcccggccctcacccggcagcccccgggggcagccccaggaccaggacgatgacgaggatgatgaggaagat

SEQ ID NO: 168018 - DNA, 1691 bp, Homo sapiens
  Payload ID: 13049
  Gene Symbol: KCNN1
  Gene Name: potassium channel, calcium activated intermediate/small conductance subfamily N alpha, member 1
  ENST ID: ENST00000615435
  CDS Start-End: 21-1652
acccctgcacccaggtagtcatgaacagccacagctacaatggcagcgtggggcggccgctgggcagcgggccgggcgccctgggacgagaccctccggaccctgaggccggccaccccccacaacccccgcacagcccgggcctccaggtggtagtggccaagagtgagccagcccggccctcacccggcagcccccgggggcagccccaggaccaggacgatgacgaggatgatgaggaagatgaggccggcaggcagagagcctcggggaaaccctcaaatgtgggccaccgcctgggccaccggcgggcgctcttcgagaagcggaagcgcctcagcgactatgccctcattttcggcatgtttggcatcgtcgtcatggtgacggagaccgagctgtcctggggggtgtacaccaaggagtctctgtactcattcgcactcaaatgcctcatcagcctctccacggccatcctgctgggtctcgttgtcctctaccatgcccgggagatccagctgttcatggtggacaacggggctgatgactggcgcatcgccatgacctgcgagcgcgtgttcctcatctcgctagagctggcagtgtgcgccattcacccggtgcccggccactaccgcttcacgtggacggcgcggctggccttcacgtacgcgccctcggtggccgaggccgacgtggacgtgctgctgtccatccccatgttcctgcgcctctacctgctgggccgggtgatgctactgcacagcaaaatcttcacggacgcctcgagccgcagcatcggggccctcaacaagatcaccttcaacacgcgcttcgtcatgaagacactcatgaccatctgccccggcaccgtgctgctggtcttcagcatctcctcctggatcatcgcagcctggaccgtgcgcgtctgcgagaggtaccacgacaagcaggaagtgaccagcaacttcctgggggccatgtggctgatttccatcaccttcctctccattggctacggcgacatggtgccccacacctactgcgggaagggtgtgtgcctgctcactggcatcatgggagctggctgtaccgcgctcgtggtggctgtggtggctcggaagctggagctcaccaaggctgagaagcacgtgcacaacttcatgatggacactcagctcaccaagcgggtaaaaaacgccgctgctaacgttctcagggagacgtggctcatctacaaacataccaggctggtgaagaagccagaccaagcccgggttcggaaacaccagcgtaagttcctccaagccatccatcaggtccagaggctccggagtgtgaagatcgagcaagggaagctgaacgaccaggctaacacgcttaccgacctagccaagacccagaccgtcatgtacgaccttgtatcggagctgcacgctcagcacgaggagctggaggcccgcctggccaccctggaaagccgcttggatgcgctgggtgcctctctacaggccctgcctggcctcatcgcccaagccatacgcccacccccgcctcccctgcctcccaggcccggccccggcccccaagaccaggcagcccggagctccccctgccggtggacgcccgtggccccctcggactgcgggtgacggccctgcccgccaccagacccctaaatcttggccatc

SEQ ID NO: 168019 - DNA, 2512 bp, Homo sapiens
  Payload ID: 13050
  Gene Symbol: KCNN2
  Gene Name: potassium channel, calcium activated intermediate/small conductance subfamily N alpha, member 2
  Uniprot ID: Q9H2S1
  ENST ID: ENST00000264773
  CDS Start-End: 458-2197
cggcggcagcagcccatgcctccggtgcaacagctgcgcctcctccggtgccccggcggcgggggcgggagataacctgtccctgctgctccgcacctcctcgcccggcggcgccttccggacccgcacctcctcgccgctgtcgggctcgtcctgctgctgctgctgctgctcgtcgcgccggggcagccagctcaatgtgagcgagctgacgccgtccagccatgccagtgcgctccggcagcagtacgcgcagcagtccgcgcagcagtcggcgtccgcctcccagtaccaccagtgccacagcctgcagcccgccgccagccccacgggcagcctcggcagtctgggctccgggcccccgctctcgcaccaccaccaccacccgcacccggcgcaccaccagcaccaccagccccaggcgcgccgcgagagcaaccccttcaccgaaatagccatgagcagctgcaggtacaacgggggcgtcatgcggccgctcagcaacttgagcgcgtcccgccggaacctgcacgagatggactcagaggcgcagcccctgcagccccccgcgtctgtcggaggaggtggcggcgcgtcctccccgtctgcagccgctgccgccgccgccgctgtttcgtcctcagcccccgagatcgtggtgtctaagcccgagcacaacaactccaacaacctggcgctctatggaaccggcggcggaggcagcactggaggaggcggcggcggtggcgggagcgggcacggcagcagcagtggcaccaagtccagcaaaaagaaaaaccagaacatcggctacaagctgggccaccggcgcgccctgttcgaaaagcgcaagcggctcagcgactacgcgctcatcttcggcatgttcggcatcgtggtcatggtcatcgagaccgagctgtcgtggggcgcctacgacaaggcgtcgctgtattccttagctctgaaatgccttatcagtctctccacgatcatcctgctcggtctgatcatcgtgtaccacgccagggaaatacagttgttcatggtggacaatggagcagatgactggagaatagccatgacttatgagcgtattttcttcatctgcttggaaatactggtgtgtgctattcatcccatacctgggaattatacattcacatggacggcccggcttgccttctcctatgccccatccacaaccaccgctgatgtggatattattttatctataccaatgttcttaagactctatctgattgccagagtcatgcttttacatagcaaacttttcactgatgcctcctctagaagcattggagcacttaataagataaacttcaatacacgttttgttatgaagactttaatgactatatgcccaggaactgtactcttggtttttagtatctcattatggataattgccgcatggactgtccgagcttgtgaaaggtaccatgatcaacaggatgttactagcaacttccttggagcgatgtggttgatatcaataacttttctctccattggttatggtgacatggtacctaacacatactgtggaaaaggagtctgcttacttactggaattatgggtgctggttgcacagccctggtggtagctgtagtggcaaggaagctagaacttaccaaagcagaaaaacacgtgcacaatttcatgatggatactcagctgactaaaagagtaaaaaatgcagctgccaatgtactcagggaaacatggctaatttacaaaaatacaaagctagtgaaaaagatagatcatgcaaaagtaagaaaacatcaacgaaaattcctgcaagctattcatcaattaagaagtgtaaaaatggagcagaggaaactgaatgaccaagcaaacactttggtggacttggcaaagacccagaacatcatgtatgatatgatttctgacttaaacgaaaggagtgaagacttcgagaagaggattgttaccctggaaacaaaactagagactttgattggtagcatccacgccctccctgggctcataagccagaccatcaggcagcagcagagagatttcattgaggctcagatggagagctacgacaagcacgtcacttacaatgctgagcggtcccggtcctcgtccaggaggcggcggtcctcttccacagcaccaccaacttcatcagagagtagctagaagagaataagttaaccacaaaataagactttttgccatcatatggtcaatattttagcttttattgtaaagcccctatggttctaatcagcgttatccgggttctgatgtcagaatcctgggaacctgaacactaagttttaggccaaaatgagtgaaaactctttttttttctttcagatgcacagggaatgcacctattattgctatatagattgttcctcctgtaatttcactaactttttattcatgcacttcaaacaaactttactactacattatatgatatataataaaaaaagttaatttctgcac

SEQ ID NO: 168020 - DNA, 879 bp, Homo sapiens
  Payload ID: 13050
  Gene Symbol: KCNN2
  Gene Name: potassium channel, calcium activated intermediate/small conductance subfamily N alpha, member 2
  ENST ID: ENST00000505491
  CDS Start-End: 396-683
tgctactgctcactctttgggtccacactgcctttatgagctgtaacactcaccgcgaaaggtctgcagcttcactcctgaagccagcgagcccacgagcccacagggaggaatgaacaactccagatgcaccgccttaagagctgtaacactcacggcgaaggtctgcagcttcactcctgagccagcgagaccaggaacccaccagaaggaagaaactccgaacacatccgaacatcagaaggaacaaactccagacggcgccaccttaagagctgtaacactcaccgccagggtccggggcttcgttcttgaagtcagtgagaccaagaacccaccaattccggacgcagtaccatgatcaacaggatgttactagcaacttccttggagcgatgtggttgatatcaataacttttctctccattggttatggtgacatggtacctaacacatactgtggaaaaggagtctgcttacttactggaattatgggtgctggttgcacagccctggtggtagctgtagtggcaaggaagctagaacttaccaaagcagaaaaacacgtgcacaatttcatgatggatactcagctgactaaaagaggaaaggaagatcatggagacaacaattgcaatacacggtggagaactcaacaccccttgattaaaaaaaaaaaatagttgaataaaaaagaagtttcctgaaggagtaaaaaatgcagctgccaatgtactcagggaaacatggctaatttacaaaaatacaaagctagtgaaaaagatagatcatgcaaaagtaagaaaacatcaacgaaaattcctgcaagctattcatcaattaagaagtgtaaaaatggagcagaggaaactgaatgac

SEQ ID NO: 168021 - DNA, 1457 bp, Homo sapiens
  Payload ID: 13050
  Gene Symbol: KCNN2
  Gene Name: potassium channel, calcium activated intermediate/small conductance subfamily N alpha, member 2
  Uniprot ID: Q9H2S1
  ENST ID: ENST00000503706
  CDS Start-End: 444-1139
cttcaacactgtggaagctttgttctttcgctcttttgcaataaatcttgctactgctcactctttgggtccacactgcctttatgagctgtaacactcaccgcgaaaggtctgcagcttcactcctgaagccagcgagcccacgagcccacagggaggaatgaacaactccagatgcaccgccttaagagctgtaacactcacggcgaaggtctgcagcttcactcctgagccagcgagaccaggaacccaccagaaggaagaaactccgaacacatccgaacatcagaaggaacaaactccagacggcgccaccttaagagctgtaacactcaccgccagggtccggggcttcgttcttgaagtcagtgagaccaagaacccaccaattccggacgcagtaccatgatcaacaggatgttactagcaacttccttggagcgatgtggttgatatcaataacttttctctccattggttatggtgacatggtacctaacacatactgtggaaaaggagtctgcttacttactggaattatgggtgctggttgcacagccctggtggtagctgtagtggcaaggaagctagaacttaccaaagcagaaaaacacgtgcacaatttcatgatggatactcagctgactaaaagagtaaaaaatgcagctgccaatgtactcagggaaacatggctaatttacaaaaatacaaagctagtgaaaaagatagatcatgcaaaagtaagaaaacatcaacgaaaattcctgcaagctattcatcaattaagaagtgtaaaaatggagcagaggaaactgaatgaccaagcaaacactttggtggacttggcaaagacccagaacatcatgtatgatatgatttctgacttaaacgaaaggagtgaagacttcgagaagaggattgttaccctggaaacaaaactagagactttgattggtagcatccacgccctccctgggctcataagccagaccatcaggcagcagcagagagatttcattgaggctcagatggagagctacgacaagcacgtcacttacaatgctgagcggtcccggtcctcgtccaggaggcggcggtcctcttccacagcaccaccaacttcatcagagagtagctagaagagaataagttaaccacaaaataagactttttgccatcatatggtcaatattttagcttttattgtaaagcccctatggttctaatcagcgttatccgggttctgatgtcagaatcctgggaacctgaacactaagttttaggccaaaatgagtgaaaactctttttttttctttcagatgcacagggaatgcacctattattgctatatagattgttcctcctgtaatttcactaactttttattcatgcacttcaaacaaactttactactacattatatgatatataataaaaaaagttaatttctgcacata

SEQ ID NO: 168022 - DNA, 3076 bp, Homo sapiens
  Payload ID: 13050
  Gene Symbol: KCNN2
  Gene Name: potassium channel, calcium activated intermediate/small conductance subfamily N alpha, member 2
  Uniprot ID: Q9H2S1
  ENST ID: ENST00000512097
  CDS Start-End: 1019-2758
gtgaggaggaggaagagaagcagaagagcagctggaggccggcggtggctgagcagcccccacacctttgagcgagccgcctgcctctccaccggcaaggaagccctgggacctccggattcgggctgccggagggcctgagcgccagagcccaggacccggcggccgggggcgccatcccctcatgttctggagaaggcgcaaatgtgatgtcatgcccattgttttggtgcgcccaaccaatcggactcgccgcctggattctaccggagccggcatgggcccttcctcgcaccagcagcaggagtccccgctcccgaccataacgcattgcgcagggtgcaccaccgcttggtctccctgcagctttaacagccctgacatggaaaccccattgcagttccagcgcggcttcttcccagagcagccgccgccgccgccgcgctcctcacacctgcattgccagcagcagcaacagagccaggacaagccgtgcccgcccttcgcgcccctcccgcaccctcaccaccacccgcacctcgcgcaccagcagccggccagcggcggcagcagcccatgcctccggtgcaacagctgcgcctcctccggtgccccggcggcgggggcgggagataacctgtccctgctgctccgcacctcctcgcccggcggcgccttccggacccgcacctcctcgccgctgtcgggctcgtcctgctgctgctgctgctgctcgtcgcgccggggcagccagctcaatgtgagcgagctgacgccgtccagccatgccagtgcgctccggcagcagtacgcgcagcagtccgcgcagcagtcggcgtccgcctcccagtaccaccagtgccacagcctgcagcccgccgccagccccacgggcagcctcggcagtctgggctccgggcccccgctctcgcaccaccaccaccacccgcacccggcgcaccaccagcaccaccagccccaggcgcgccgcgagagcaaccccttcaccgaaatagccatgagcagctgcaggtacaacgggggcgtcatgcggccgctcagcaacttgagcgcgtcccgccggaacctgcacgagatggactcagaggcgcagcccctgcagccccccgcgtctgtcggaggaggtggcggcgcgtcctccccgtctgcagccgctgccgccgccgccgctgtttcgtcctcagcccccgagatcgtggtgtctaagcccgagcacaacaactccaacaacctggcgctctatggaaccggcggcggaggcagcactggaggaggcggcggcggtggcgggagcgggcacggcagcagcagtggcaccaagtccagcaaaaagaaaaaccagaacatcggctacaagctgggccaccggcgcgccctgttcgaaaagcgcaagcggctcagcgactacgcgctcatcttcggcatgttcggcatcgtggtcatggtcatcgagaccgagctgtcgtggggcgcctacgacaaggcgtcgctgtattccttagctctgaaatgccttatcagtctctccacgatcatcctgctcggtctgatcatcgtgtaccacgccagggaaatacagttgttcatggtggacaatggagcagatgactggagaatagccatgacttatgagcgtattttcttcatctgcttggaaatactggtgtgtgctattcatcccatacctgggaattatacattcacatggacggcccggcttgccttctcctatgccccatccacaaccaccgctgatgtggatattattttatctataccaatgttcttaagactctatctgattgccagagtcatgcttttacatagcaaacttttcactgatgcctcctctagaagcattggagcacttaataagataaacttcaatacacgttttgttatgaagactttaatgactatatgcccaggaactgtactcttggtttttagtatctcattatggataattgccgcatggactgtccgagcttgtgaaaggtaccatgatcaacaggatgttactagcaacttccttggagcgatgtggttgatatcaataacttttctctccattggttatggtgacatggtacctaacacatactgtggaaaaggagtctgcttacttactggaattatgggtgctggttgcacagccctggtggtagctgtagtggcaaggaagctagaacttaccaaagcagaaaaacacgtgcacaatttcatgatggatactcagctgactaaaagagtaaaaaatgcagctgccaatgtactcagggaaacatggctaatttacaaaaatacaaagctagtgaaaaagatagatcatgcaaaagtaagaaaacatcaacgaaaattcctgcaagctattcatcaattaagaagtgtaaaaatggagcagaggaaactgaatgaccaagcaaacactttggtggacttggcaaagacccagaacatcatgtatgatatgatttctgacttaaacgaaaggagtgaagacttcgagaagaggattgttaccctggaaacaaaactagagactttgattggtagcatccacgccctccctgggctcataagccagaccatcaggcagcagcagagagatttcattgaggctcagatggagagctacgacaagcacgtcacttacaatgctgagcggtcccggtcctcgtccaggaggcggcggtcctcttccacagcaccaccaacttcatcagagagtagctagaagagaataagttaaccacaaaataagactttttgccatcatatggtcaatattttagcttttattgtaaagcccctatggttctaatcagcgttatccgggttctgatgtcagaatcctgggaacctgaacactaagttttaggccaaaatgagtgaaaactctttttttttctttcagatgcacagggaatgcacctattattgctatatagattgttcctcctgtaatttcactaactttttattcatgcacttcaaacaaactttactactacattatatgatatataataaaaaaagttaatttctgcacata

SEQ ID NO: 168023 - DNA, 2091 bp, Homo sapiens
  Payload ID: 13050
  Gene Symbol: KCNN2
  Gene Name: potassium channel, calcium activated intermediate/small conductance subfamily N alpha, member 2
  Uniprot ID: Q9H2S1
  ENST ID: ENST00000610748
  CDS Start-End: 1083-1778
cggcggcagcagcccatgcctccggtgcaacagctgcgcctcctccggtgccccggcggcgggggcgggagataacctgtccctgctgctccgcacctcctcgcccggcggcgccttccggacccgcacctcctcgccgctgtcgggctcgtcctgctgctgctgctgctgctcgtcgcgccggggcagccagctcaatgtgagcgagctgacgccgtccagccatgccagtgcgctccggcagcagtacgcgcagcagtccgcgcagcagtcggcgtccgcctcccagtaccaccagtgccacagcctgcagcccgccgccagccccacgggcagcctcggcagtctgggctccgggcccccgctctcgcaccaccaccaccacccgcacccggcgcaccaccagcaccaccagccccaggcgcgccgcgagagcaaccccttcaccgaaatagccatgagcagctgcaggtacaacgggggcgtcatgcggccgctcagcaacttgagcgcgtcccgccggaacctgcacgagatggactcagaggcgcagcccctgcagccccccgcgtctgtcggaggaggtggcggcgcgtcctccccgtctgcagccgctgccgccgccgccgctgtttcgtcctcagcccccgagatcgtggtgtctaagcccgagcacaacaactccaacaacctggcgctctatggaaccggcggcggaggcagcactggaggaggcggcggcggtggcgggagcgggcacggcagcagcagtggcaccaagtccagcaaaaagaaaaaccagaacatcggctacaagctgggccaccggcgcgccctgttcgaaaagcgcaagcggctcagcgactacgcgctcatcttcggcatgttcggcatcgtggtcatggtcatcgagaccgagctgtcgtggggcgcctacgacaaggcgtcgctgtattccttagctctgaaatgccttatcagtctctccacgatcatcctgctcggtctgatcatcgtgtaccacgccagggaaatacaggtaccatgatcaacaggatgttactagcaacttccttggagcgatgtggttgatatcaataacttttctctccattggttatggtgacatggtacctaacacatactgtggaaaaggagtctgcttacttactggaattatgggtgctggttgcacagccctggtggtagctgtagtggcaaggaagctagaacttaccaaagcagaaaaacacgtgcacaatttcatgatggatactcagctgactaaaagagtaaaaaatgcagctgccaatgtactcagggaaacatggctaatttacaaaaatacaaagctagtgaaaaagatagatcatgcaaaagtaagaaaacatcaacgaaaattcctgcaagctattcatcaattaagaagtgtaaaaatggagcagaggaaactgaatgaccaagcaaacactttggtggacttggcaaagacccagaacatcatgtatgatatgatttctgacttaaacgaaaggagtgaagacttcgagaagaggattgttaccctggaaacaaaactagagactttgattggtagcatccacgccctccctgggctcataagccagaccatcaggcagcagcagagagatttcattgaggctcagatggagagctacgacaagcacgtcacttacaatgctgagcggtcccggtcctcgtccaggaggcggcggtcctcttccacagcaccaccaacttcatcagagagtagctagaagagaataagttaaccacaaaataagactttttgccatcatatggtcaatattttagcttttattgtaaagcccctatggttctaatcagcgttatccgggttctgatgtcagaatcctgggaacctgaacactaagttttaggccaaaatgagtgaaaactctttttttttctttcagatgcacagggaatgcacctattattgctatatagattgttcctcctgtaatttcactaactttttattcatgcacttcaaacaaactttactactacattatatgatatataataaaaaaagttaatttctgc

SEQ ID NO: 168024 - DNA, 2098 bp, Homo sapiens
  Payload ID: 13050
  Gene Symbol: KCNN2
  Gene Name: potassium channel, calcium activated intermediate/small conductance subfamily N alpha, member 2
  ENST ID: ENST00000631899
  CDS Start-End: 39-1787
aggcgcgccgcgagagcaaccccttcaccgaaatagccatgagcagctgcaggtacaacgggggcgtcatgcggccgctcagcaacttgagcgcgtcccgccggaacctgcacgagatggactcagaggcgcagcccctgcagccccccgcgtctgtcggaggaggtggcggcgcgtcctccccgtctgcagccgctgccgccgccgccgctgtttcgtcctcagcccccgagatcgtggtgtctaagcccgagcacaacaactccaacaacctggcgctctatggaaccggcggcggaggcagcactggaggaggcggcggcggtggcgggagcgggcacggcagcagcagtggcaccaagtccagcaaaaagaaaaaccagaacatcggctacaagctgggccaccggcgcgccctgttcgaaaagcgcaagcggctcagcgactacgcgctcatcttcggcatgttcggcatcgtggtcatggtcatcgagaccgagctgtcgtggggcgcctacgacaaggcgtcgctgtattccttagctctgaaatgccttatcagtctctccacgatcatcctgctcggtctgatcatcgtgtaccacgccagggaaatacagttgttcatggtggacaatggagcagatgactggagaatagccatgacttatgagcgtattttcttcatctgcttggaaatactggtgtgtgctattcatcccatacctgggaattatacattcacatggacggcccggcttgccttctcctatgccccatccacaaccaccgctgatgtggatattattttatctataccaatgttcttaagactctatctgattgccagagtcatgcttttacatagcaaacttttcactgatgcctcctctagaagcattggagcacttaataagataaacttcaatacacgttttgttatgaagactttaatgactatatgcccaggaactgtactcttggtttttagtatctcattatggataattgccgcatggactgtccgagcttgtgaaaggtaccatgatcaacaggatgttactagcaacttccttggagcgatgtggttgatatcaataacttttctctccattggttatggtgacatggtacctaacacatactgtggaaaaggagtctgcttacttactggaattatgggtgctggttgcacagccctggtggtagctgtagtggcaaggaagctagaacttaccaaagcagaaaaacacgtgcacaatttcatgatggatactcagctgactaaaagagtaaaaaatgcagctgccaatgtactcagggaaacatggctaatttacaaaaatacaaagctagtgaaaaagatagatcatgcaaaagtaagaaaacatcaacgaaaattcctgcaagctattcatcaagctcggaaattaagaagtgtaaaaatggagcagaggaaactgaatgaccaagcaaacactttggtggacttggcaaagacccagaacatcatgtatgatatgatttctgacttaaacgaaaggagtgaagacttcgagaagaggattgttaccctggaaacaaaactagagactttgattggtagcatccacgccctccctgggctcataagccagaccatcaggcagcagcagagagatttcattgaggctcagatggagagctacgacaagcacgtcacttacaatgctgagcggtcccggtcctcgtccaggaggcggcggtcctcttccacagcaccaccaacttcatcagagagtagctagaagagaataagttaaccacaaaataagactttttgccatcatatggtcaatattttagcttttattgtaaagcccctatggttctaatcagcgttatccgggttctgatgtcagaatcctgggaacctgaacactaagttttaggccaaaatgagtgaaaactctttttttttctttcagatgcacagggaatgcacctattattgctatatagattgttcctcctgtaatttcactaactttttattcatgcacttcaaacaaactttactactacattatatgatatataataaaaaaagttaatttct

SEQ ID NO: 168025 - DNA, 13033 bp, Homo sapiens
  Payload ID: 13051
  Gene Symbol: KCNN3
  Gene Name: potassium channel, calcium activated intermediate/small conductance subfamily N alpha, member 3
  ENST ID: ENST00000271915
  CDS Start-End: 317-2512
ttgagccagcgaggagtgaagctgagcctggcctcacacgctcctagaggaccacctcctgagagagttctttcaccccctcttctttctccaagctcccctcctgctctccctccctgcccaatacaatgcattcttgagtggcagcgtctggactccaggcagccccagagaaccgaagcaagccaaagagaggactggagccaagatactggtgggggagattggatgcctggctttctttgaggacatctttggagcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggactccatgttttcgttggccctgaaatgccttatcagtctgtccaccatcatccttttgggcttgatcatcgcctaccacacacgtgaagtccagctcttcgtgatcgacaatggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaaaaaaaaaaaaagacacagacaaataaaaagccagattttccactcgatattaatacccacataaacctgtgtgtttgcaaacgtgtacatgtacacacatacacatcccacgttcgcttcaggtcctttcttatttgagcttaatccaaataaaaagggacttgacaccttaccctgcatacaataggcaccccttacatgtgttttgagttggtctgaatctgaacatggggtgctttcagttcaggtagttagctagttctggccacattctgagtttcactgaagatgtggatcccttcagacataatgcacattgctttgtcctggatatgcaccttgcttgatttgaaatggatgccaagccaaaattgttggcattcaggagggataagcaggcttctaaaaataacagcatctgcagagttttcttcttccatccaaacaagttgtgtttcgatggtccacatgaccaggtgtatgtctgtaagtgtggagggagaggacaagaaattgtgcatgtgtgtgcagacatgcacaaacaggagcaatccaataacaccttagtgaatagaaatatggttggggatttgctgagctgtatttatccagcaacaggtttccagccccagatgttagtagtgcaaaagggccaagtgcctcaattgtgagcctctgagctaggaggagaagtgatgaagagtggcctatgtggtcccttctacctgaccttaagtcatctcaaaatgaaatattgtgagaatgaagggaacccttagggaaccttgtgggtaaggtaagtggacatggatttgtcagtagcctgttcctactgtgccatgttaatcttggtgcgaaaaactattccaatacatctcaaactccaagagacttcagaaacatcaagatttagtgtaatgagcggcgcagaaaaatgttttcattgctccataatctgaccacacgtaacatttgtgacgtgaaaaccatgactttctcattctgaggtctttggtttctgcctgtgggaaattgaatggcactgtatggactatttcatctgttgatggtaaaacaaaagggtgatttttttgcttgtggttgtcatcttgggtttacctttgtaagaagacatcatcaccattctgaaggcagtggcttggcatggagatttttattctgtagcactgggcctgttcttctaaggacagcacaaggtagacaattgtagagccaaggccactttttcaggaagatctagtctcttgctaaccctcttctttctctcttgctattgctgctgctcttttgatggtttatagtcttaatggcctgccttgataattcctttgaacactttcattagttgttttgcataccagagatgccgcacctgctgttggcttatttttttacttgttctattaactgttgattatctgaatgtttcccctcctccttgtttcatgtcccaagaatggtgctcctgttttcagtgacagttcagctgaacatataagcagatgtgtaaacagatgaagtaaccatgcagtttccttgtggcattagttccatttcacaaagtgaagaccactggtgggctgatctgagtgtgccaatcctgatcatttaaacctacagccttcaactggtgattcctacccaccgttttcattctgctataaccctgtgatatgtgtgcgtgtgggtgtgagtgtgggtgtgtgcacatatagagatttagtcttaatttcaaccaaatgacatgcaagattccactgccactcttcctggccaaaagtgtgcacagactgtgatttattcattgtggtctgtgactttaacccatcattgatgctctcacttaggtaaaccctaaagaccaaactagcaacactagtcaagggagtgactggagttatttctggtagcagtagccactggcatcctagaaacacatggacatttgtagcatgaattgacctattggtagtgcaatagctatacatgatttttattcttggcaaaagaaaatgcttcaaaaaaaaagtgatcaaacctgcacattgatcctgtaatagcaaatggaaggctatttctctgtactagcatttcagctttatgtgggaaagttacccgttctcctgcaagtacaatcaacccttgatgacttaagtattaattattctgggtgtagctcacccaagttttcttcctacatcttttggctaattccaccacacctcagcatcacagtcagatgggaaaaggggcaggtggattctcatgtcatgccttcttgtaccttattttcaagttttgtggtggaggaggtttaattatctgctcaagaatctggtatatatagccaggtgcggtggctcatgcctgtaatcccaggactttgggcaaggcgagaggatcacctgaggtcaggagttcaagaccagcctggccaacatggcaaaaccccatctctactaaaaatacaaaaattagctgggtttggtggtggacacctgtagtcccagctacttgggaggctgcggcaggagaatcacttgaaccccggaagtggaggttgcagtgagccaagatcgtgccattgcactccagcttgggtgaccgagcaagactccgtctcaaaaaaaaaaaaaaaatcggctatatgtaaaaactattaattatgtaacctcactccaatactgtactgatcaagatctgcccactcctagaggactgacccaatggcagatcccctactataatctttctgacaactcagtgacaggtaaaatcactctaatattcctaaaatatctagacacttgaattagaaatacagaaccacccccacccctgccattgcttaagccatattaaagcttcatgtactgtaaagtcagggatgtactgtgatactttaagaccactaatctcagtggaatttcaggacatagcattagttggtaaattacaccagactaggggctcactcctccttagattgaagtccaaataaaagtcttcacctttggatcaaaggccacatatatatgatcatcatcaataaattgtcataaagtgtctatgaactgctcttgccatcttcctaatacgtaacttcatgacatcatgtctctagaagtgcttaatacaatccaaaagaacaaggggggaaggccccaagtcaccactgaccgacctcagcaggggccagtggtagaacaacaatcttgtgaattaggagacatagaaaatgtacgcaaaagtaaattccaagcgctgagcatgtacaagctatttttattattaaaagccaagaaggaagagcattgaagaagtaatgattttaatatagtgggggatttcccccttaaatttttataatttccttgtgaataaacaatcatggaaaagaagaaacctagtcatacaaaatcagaataaataaaaatcttaagactggatccacatctttggccaattcatataagcacctaatacatcaatttctctgtacttaaaatgaagagaataattaatattcttaagtacaatgttttcaatagagaacaaatgaaatcacctttgtcatcaacagcagcccagactgactgtatctagatcacaccttgatgttacgtttgaatgcagtcagtagttaccaaaaagtaattagtgcacattaaatagtggtaaaatcagcagggagaaatatgggattagcacgtagttccagaaccttcctcctcctccagagtgcaactcaacaaacagtacactccaaattaagaatcaatgtttcatcccaggacaaacggtgttgctcccatcacagtaccacaactgagatactgtgaagtcattgcactaccagtaggttactactcttttgaagttactgtttttaaatcctaaaatatgtccccagttttctacattcattcttcttcccctaagagttgctagaagcagatgaaggatccctattgactctgcagggtttgatttcagtaccttagacagctatctggtgacttcccagtaggcacgaacaaccccttctctccccttgcagtcggtgggcttgatgacgccccagacagtatcctttccttctctactgccgccaaaataaacattagggaaatgggatcattaacaccactgagaaaggagtttacagggatcgcaatagtaactgtctgcttgtggtagtagaaagcttgtgccaggctgcatgaatagaaattaatgttaaactcctgttagacgagtaatatgtagatttttattgaaacagaccacagcttattaaaaagtactcagtgcaatggtatatacatatatacagatagaaaaaaatataactgtgatctttttgtcttacgccattactggaaacacccaaacgtgaactggagttccctctgaacaaaaccattgtcaaatcttcaacatatgacctccaaatctaggtgccaagtgccctgtgacagttgtttacacacctgaaaaatgtatcctggaagctgtaatcttgggcctgggctatgtgttgaaacaagcaaaagagacacatcgtgaccaaccaagctggtggaggaaaagcacaaaattcaactccaacctgcagttaggatcccaaagagatgttgacatttatagccaaaaagaaaaagtacatatatatatatatatatatatatatatatatatatatatatatatatctgaatcagatcgaagcagccaacgtccagcttcactcaagaaggacaaggaataaacaacattctctagctgtgtcatgttgtctcagtttttgaatctcaaccaggactgatccaccttcatcagatacgttttttaatggcgcaacaactcaattttggtcccagactctccattctgcactggccacgagaacaacaagagaatgacaggatgttaatggaggaaacattttcatggcaagctcagaaactgaagtgtttatattcagaatcagatgagctttaatatgaatttgcatcttgcctctgtactgcttgctattttttaatgataggagaaagcataacagtttattttaaatatgaaatatattgatatattataaaatatattgtaactttcaattaacattttgtatcaaactagtgtttagcaggtccactgtcagcctgctctcccaatgactgtttctgagtacacatcactgttagtgattgccgggcacccagaaaaagggtcctcctaccacagcctactgaactgccatattctaattctccaaggcctgggtattagagacaaaagaacattattccaagagtagaggaataattctaccctaaattctatcaagccatttcagaagagattttaaaagccatcactcctttagtagctctgcaaagccagtttaataaaagttcaggctctttctatataaattcaaaggcctcattacataaattatataagtctcaaacctagccaaccagttttcctttgacaatgtcagaattggacataagaaagagtcctgttttcctgtaacttaaaatactcaaaatcctaggcattctgagtttctccatgtacgtgaaaccggggtcggctttccaaactacacaaggcccaacaagagtccagtgtgcagatgtgcttttctaaattggcaatacccttgagggagcaaggttcccacatgtttatcaaggacatggagcccagctcctaagggagtgatgggaggagccggcaggacatgaacagccagagccagcaaagagccgggctgccttttctgctagcttcctctagctgggaggaaataaagggttcccgttgagatattgtcctttatagcaaaattaagcaactcatggaatctacacccctctttctctacagagcagctgagacatacatgtagaagttctcagttccctccttcatatggctaaggcactacttctagatgaaaacaggatgtgttcggttacagaataaagattttctagaatcagtgagcctcttctcacctgggaccctcacttgctgttgttgctttggtgcaatattgtacaggtgcaaaccaggttgcatcggggcagattaactgagcctatgtgtctcttcccttcccaagccctgaaaattcacatagatttacagatagtgcaaaacaacaagttttctcctgggaaaaggctggaatccttcaaatttcaatttatatgagcttaaaggtatataagtcatggggctcactgacattaggtattcatgctgtttgaaagagaaatgtctaaatgcccgttttcagtctgtttgtgtagctgagccctaacttgtacacaagttttcttgttatggagctaaattctctcagtgcctgtattactcctcagttatatgttaggccgagctccactaaagccatctgaactccagggcacttgtttttatcaggttacttactcaccggataatggaaattggcttattttcaattttacaattgactgatgaatgtattggtggtaattgatttatttcttcacttttttttgctactaaatgattttttcttttttaaaattattattattattattttgagatggagtctcactctgtcgcccaggctggagtgcagtggcgccatctcagctcactgcaagctctgcctcctgggttcatgcaattctcctgcctcagcctcccgagtagctgggattacaggtgcgtgccaccacgaccagctaatttttttgtatttttagtagagacagggtttcatcatgttaaccaggatggtctcgatctcctgacctcgtgatccacctgcctgggcctcccaaagtgagccactgtgcctggcccagtaagtgcttttttcttttggtttttccttctaacactgctcagaccaagacttacatttataaagagcaaatatattctgacctttcccctcaaagttgtattccatctagaatcaaggaaacaaatgcaaattcatcatttggggaaagcagacctcttgacagtaattcaagtccatggctatatgctaacccttgctactcaaagtgtggtccacagaccagcagcgttagcatcatctgtaagcttgttagaaatgcagaatctcaggccccacatcaaaccttcttcatcagaattggccttttaacaaatccccaggtgacctgtatgcaccagaaatattgataagcactggcctcacctcaccgtagtgataactaacctcgttaataattagagaatgaagctatctcttccttgagtctcatttacagaattatttgaagatgtgaaggtcctgaatgatcataaggattaaaaaaatgcatctttaaattccacttgaggttatataacttggatggtctacatcaaacataataaagtcaataagagatagtctttttccggtcttacctaaatagcactccatatccttgagccacctcaaagcccccatttttaagttttagtctttttttttttagaccagactagcaaagccatcagaatatcaggtggaacctcagggcaggtcctctggaaggctacaggagtctctgcttagcatagtacagaaattgttgtgtttctcgatccttgtgttcttcccttgaggaactcagcatctcaccagtaagaactcccctcccctagaggaaaatagcaagagaagttagtttaaccatctagaaacattgctaatctccttgaaagccaattctcttactcattgcaccaacaagaaacactccaaggtgggcaaggaaagacgtgaattctgatattggcgccataactcgatatgtacccagaaacagttatgttctaaattaatggctttaacctgttcattgtaaaaagtgccttggacttcaatctaaagaggtcagtataaatatgtatgtgtgtgtgtgacgtgtatgtaggcaaatatttacagatttatacatacataggtgcacacacatatacccgcacattcatatataatatatacatacatatataaatgcttcataatatatcatattgctattcacagctccatttcttttgtctggtcctatgtttatttgtttagtgagacctttacatagagaggttctattcggaacattgatgtattttttgtttgttttttactttttattaaaaaggtaaaggatattaaaaaaaaaaaaaaaagtcaagtgcctgaaggttttgaatggagttacggtaaactttctcaggtcaccaaagaggaaacatttttcctttggaaaacatttttctgtttcagtgactttgttttcccttggtggtaatgcataaataagagtggttaaagtgattttgtaagttttatttcaatccatttctgtggttcccataaggcaatagctaaaaatttgttcagtctagtgcccagttttctccacacatcagcatcagaagggcccggtcttcacatgctctgtgtggttttgttcgcgttgttactgtgttccttactaaggaaaggcaaatgaaattgcaggggctggagcttagaccagctccaaatatggcttccttttggtaacacacacagaaggtggactagtgggaagtctctctccctgaagcaggtgggaacctgtgtcttagaaggcagaggagtcccagtgaactctccacagctccatgggccctgcctgtctacagttatacaactgcctgtatgagtcagcctttctctaccttagccaaaggtcttctctttctgtggtgtgacagcttgtaatgaaccaacttgctctggttagaagtccctagagctccaggaagagtcgccaggtttccattgctgtgctcaaagctcaaggacacattatacttctttaaaccaactaaatctctctagctccctgcccccatggtgacactttcataataggcagggccaagtcagagaggtcatgccctgtatacagtgtcaatcagaagagacactgcaaaatgtcagaggtgaccagaaagacaacagatctctccagctgtcctcacagctgcaggcacatttgtggaattgtgagtaggaaggcttggcagccaggggatgggaaatgaatttccccaagttgaaaaccctgtacccttactttccttcccataaatttttctgtagttctaggtaaataataataataataaaaatgcaaattaggtgctttagaaggagtatgtaatatctgggactttttctaagttggtagacctaaaaaatgttttcaaaaatatatctagctgcatttctactgctgtcattccttaaagctcttcctccaaaaactccatatgaatgaatacatttaccaactcagtgattactaaataatagtactttatacttatacacagtaatacctttcatctaaggatctcaaatgccaatatattagtcatcaccctgtaaggtggatgacatattattcccattattccaatgggaaaattgggccatagaaaactgaggagcaaatgactcatctacaggaattaaatggaaaaaacaggctaggatttctcagcacactttaggagtgaatgaaaacttacaggcttcagttctactgctggccaccattggatttgtaagatccaggatgtgtattgaccacatgtgtccagacccaggcttagggcatctggaatgagagtggtgggctggtgtgtgggtctgaggatctggatgggagactgcattttcttctctgtgcaaaatatggaagtgtgaccttgaaggtgggcttagtctatggccttccccactcctgcttgaactgaagctggagagaatgggcatttttaaatgttacggcatatgctaatataatattatggcattaaataaaaacaagaagagaactgactaaaaccaaaaaaccaaaaa

SEQ ID NO: 168026 - DNA, 1658 bp, Homo sapiens
  Payload ID: 13051
  Gene Symbol: KCNN3
  Gene Name: potassium channel, calcium activated intermediate/small conductance subfamily N alpha, member 3
  Uniprot ID: Q9UGI6
  ENST ID: ENST00000358505
  CDS Start-End: 378-1634
gaggactcagaataaacctgctgctgcttcgtaaacatctcctgataaaaatggctacaggtgttacctgggcagagcagctgggcgccgccttggaatcagctgggggagcacctctccttgggacgggatgacagggcttcccaggcggtccccacaagcccgcgccccagctcagccccagttctcccctcccacctcaactcctccttgggataaataaagatgagtgtgtgtgtgagtgcgcgcccggatggagaacagcaggcactggctttagcggggagctggccccactgctccagcctctcagtccagccccaagacggaggagggggtttccctcccagagggagtggagatggaggaaggactccatgttttcgttggccctgaaatgccttatcagtctgtccaccatcatccttttgggcttgatcatcgcctaccacacacgtgaagtccagctcttcgtgatcgacaatggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagca

SEQ ID NO: 168027 - DNA, 1962 bp, Homo sapiens
  Payload ID: 13051
  Gene Symbol: KCNN3
  Gene Name: potassium channel, calcium activated intermediate/small conductance subfamily N alpha, member 3
  Uniprot ID: Q9UGI6
  ENST ID: ENST00000361147
  CDS Start-End: 132-1412
caggaaagtcagcttaaaggacactccttgcagggactgagctggcacctactccttagagcttgctgataccaggcctgccacgcgacatctgcaaggacagttgtttggtgttttgcttcaggttatagatggagagacctataaaggactccatgttttcgttggccctgaaatgccttatcagtctgtccaccatcatccttttgggcttgatcatcgcctaccacacacgtgaagtccagctcttcgtgatcgacaatggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaaaaaaaaaaaaa

SEQ ID NO: 168028 - DNA, 13057 bp, Homo sapiens
  Payload ID: 13051
  Gene Symbol: KCNN3
  Gene Name: potassium channel, calcium activated intermediate/small conductance subfamily N alpha, member 3
  ENST ID: ENST00000618040
  CDS Start-End: 315-2555
gagccagcgaggagtgaagctgagcctggcctcacacgctcctagaggaccacctcctgagagagttctttcaccccctcttctttctccaagctcccctcctgctctccctccctgcccaatacaatgcattcttgagtggcagcgtctggactccaggcagccccagagaaccgaagcaagccaaagagaggactggagccaagatactggtgggggagattggatgcctggctttctttgaggacatctttggagcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggactccatgttttcgttggccctgaaatgccttatcagtctgtccaccatcatccttttgggcttgatcatcgcctaccacacacgtgaagtccagctcttcgtgatcgacaatggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaagtcctgaatcaccagcccagccttctggctcatcacttcctgcttggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaaaaaaaaaaaaagacacagacaaataaaaagccagattttccactcgatattaatacccacataaacctgtgtgtttgcaaacgtgtacatgtacacacatacacatcccacgttcgcttcaggtcctttcttatttgagcttaatccaaataaaaagggacttgacaccttaccctgcatacaataggcaccccttacatgtgttttgagttggtctgaatctgaacatggggtgctttcagttcaggtagttagctagttctggccacattctgagtttcactgaagatgtggatcccttcagacataatgcacattgctttgtcctggatatgcaccttgcttgatttgaaatggatgccaagccaaaattgttggcattcaggagggataagcaggcttctaaaaataacagcatctgcagagttttcttcttccatccaaacaagttgtgtttcgatggtccacatgaccaggtgtatgtctgtaagtgtggagggagaggacaagaaattgtgcatgtgtgtgcagacatgcacaaacaggagcaatccaataacaccttagtgaatagaaatatggttggggatttgctgagctgtatttatccagcaacaggtttccagccccagatgttagtagtgcaaaagggccaagtgcctcaattgtgagcctctgagctaggaggagaagtgatgaagagtggcctatgtggtcccttctacctgaccttaagtcatctcaaaatgaaatattgtgagaatgaagggaacccttagggaaccttgtgggtaaggtaagtggacatggatttgtcagtagcctgttcctactgtgccatgttaatcttggtgcgaaaaactattccaatacatctcaaactccaagagacttcagaaacatcaagatttagtgtaatgagcggcgcagaaaaatgttttcattgctccataatctgaccacacgtaacatttgtgacgtgaaaaccatgactttctcattctgaggtctttggtttctgcctgtgggaaattgaatggcactgtatggactatttcatctgttgatggtaaaacaaaagggtgatttttttgcttgtggttgtcatcttgggtttacctttgtaagaagacatcatcaccattctgaaggcagtggcttggcatggagatttttattctgtagcactgggcctgttcttctaaggacagcacaaggtagacaattgtagagccaaggccactttttcaggaagatctagtctcttgctaaccctcttctttctctcttgctattgctgctgctcttttgatggtttatagtcttaatggcctgccttgataattcctttgaacactttcattagttgttttgcataccagagatgccgcacctgctgttggcttatttttttacttgttctattaactgttgattatctgaatgtttcccctcctccttgtttcatgtcccaagaatggtgctcctgttttcagtgacagttcagctgaacatataagcagatgtgtaaacagatgaagtaaccatgcagtttccttgtggcattagttccatttcacaaagtgaagaccactggtgggctgatctgagtgtgccaatcctgatcatttaaacctacagccttcaactggtgattcctacccaccgttttcattctgctataaccctgtgatatgtgtgcgtgtgggtgtgagtgtgggtgtgtgcacatatagagatttagtcttaatttcaaccaaatgacatgcaagattccactgccactcttcctggccaaaagtgtgcacagactgtgatttattcattgtggtctgtgactttaacccatcattgatgctctcacttaggtaaaccctaaagaccaaactagcaacactagtcaagggagtgactggagttatttctggtagcagtagccactggcatcctagaaacacatggacatttgtagcatgaattgacctattggtagtgcaatagctatacatgatttttattcttggcaaaagaaaatgcttcaaaaaaaaagtgatcaaacctgcacattgatcctgtaatagcaaatggaaggctatttctctgtactagcatttcagctttatgtgggaaagttacccgttctcctgcaagtacaatcaacccttgatgacttaagtattaattattctgggtgtagctcacccaagttttcttcctacatcttttggctaattccaccacacctcagcatcacagtcagatgggaaaaggggcaggtggattctcatgtcatgccttcttgtaccttattttcaagttttgtggtggaggaggtttaattatctgctcaagaatctggtatatatagccaggtgcggtggctcatgcctgtaatcccaggactttgggcaaggcgagaggatcacctgaggtcaggagttcaagaccagcctggccaacatggcaaaaccccatctctactaaaaatacaaaaattagctgggtttggtggtggacacctgtagtcccagctacttgggaggctgcggcaggagaatcacttgaaccccggaagtggaggttgcagtgagccaagatcgtgccattgcactccagcttgggtgaccgagcaagactccgtctcaaaaaaaaaaaaaaaatcggctatatgtaaaaactattaattatgtaacctcactccaatactgtactgatcaagatctgcccactcctagaggactgacccaatggcagatcccctactataatctttctgacaactcagtgacaggtaaaatcactctaatattcctaaaatatctagacacttgaattagaaatacagaaccacccccacccctgccattgcttaagccatattaaagcttcatgtactgtaaagtcagggatgtactgtgatactttaagaccactaatctcagtggaatttcaggacatagcattagttggtaaattacaccagactaggggctcactcctccttagattgaagtccaaataaaagtcttcacctttggatcaaaggccacatatatatgatcatcatcaataaattgtcataaagtgtctatgaactgctcttgccatcttcctaatacgtaacttcatgacatcatgtctctagaagtgcttaatacaatccaaaagaacaaggggggaaggccccaagtcaccactgaccgacctcagcaggggccagtggtagaacaacaatcttgtgaattaggagacatagaaaatgtacgcaaaagtaaattccaagcgctgagcatgtacaagctatttttattattaaaagccaagaaggaagagcattgaagaagtaatgattttaatatagtgggggatttcccccttaaatttttataatttccttgtgaataaacaatcatggaaaagaagaaacctagtcatacaaaatcagaataaataaaaatcttaagactggatccacatctttggccaattcatataagcacctaatacatcaatttctctgtacttaaaatgaagagaataattaatattcttaagtacaatgttttcaatagagaacaaatgaaatcacctttgtcatcaacagcagcccagactgactgtatctagatcacaccttgatgttacgtttgaatgcagtcagtagttaccaaaaagtaattagtgcacattaaatagtggtaaaatcagcagggagaaatatgggattagcacgtagttccagaaccttcctcctcctccagagtgcaactcaacaaacagtacactccaaattaagaatcaatgtttcatcccaggacaaacggtgttgctcccatcacagtaccacaactgagatactgtgaagtcattgcactaccagtaggttactactcttttgaagttactgtttttaaatcctaaaatatgtccccagttttctacattcattcttcttcccctaagagttgctagaagcagatgaaggatccctattgactctgcagggtttgatttcagtaccttagacagctatctggtgacttcccagtaggcacgaacaaccccttctctccccttgcagtcggtgggcttgatgacgccccagacagtatcctttccttctctactgccgccaaaataaacattagggaaatgggatcattaacaccactgagaaaggagtttacagggatcgcaatagtaactgtctgcttgtggtagtagaaagcttgtgccaggctgcatgaatagaaattaatgttaaactcctgttagacgagtaatatgtagatttttattgaaacagaccacagcttattaaaaagtactcagtgcaatggtatatacatatatacagatagaaaaaaatataactgtgatctttttgtcttacgccattactggaaacacccaaacgtgaactggagttccctctgaacaaaaccattgtcaaatcttcaacatatgacctccaaatctaggtgccaagtgccctgtgacagttgtttacacacctgaaaaatgtatcctggaagctgtaatcttgggcctgggctatgtgttgaaacaagcaaaagagacacatcgtgaccaaccaagctggtggaggaaaagcacaaaattcaactccaacctgcagttaggatcccaaagagatgttgacatttatagccaaaaagaaaaagtacatatatatatatatatatatatatatatatatatatatatatatatatctgaatcagatcgaagcagccaacgtccagcttcactcaagaaggacaaggaataaacaacattctctagctgtgtcatgttgtctcagtttttgaatctcaaccaggactgatccaccttcatcagatacgttttttaatggcgcaacaactcaattttggtcccagactctccattctgcactggccacgagaacaacaagagaatgacaggatgttaatggaggaaacattttcatggcaagctcagaaactgaagtgtttatattcagaatcagatgagctttaatatgaatttgcatcttgcctctgtactgcttgctattttttaatgataggagaaagcataacagtttattttaaatatgaaatatattgatatattataaaatatattgtaactttcaattaacattttgtatcaaactagtgtttagcaggtccactgtcagcctgctctcccaatgactgtttctgagtacacatcactgttagtgattgccgggcacccagaaaaagggtcctcctaccacagcctactgaactgccatattctaattctccaaggcctgggtattagagacaaaagaacattattccaagagtagaggaataattctaccctaaattctatcaagccatttcagaagagattttaaaagccatcactcctttagtagctctgcaaagccagtttaataaaagttcaggctctttctatataaattcaaaggcctcattacataaattatataagtctcaaacctagccaaccagttttcctttgacaatgtcagaattggacataagaaagagtcctgttttcctgtaacttaaaatactcaaaatcctaggcattctgagtttctccatgtacgtgaaaccggggtcggctttccaaactacacaaggcccaacaagagtccagtgtgcagatgtgcttttctaaattggcaatacccttgagggagcaaggttcccacatgtttatcaaggacatggagcccagctcctaagggagtgatgggaggagccggcaggacatgaacagccagagccagcaaagagccgggctgccttttctgctagcttcctctagctgggaggaaataaagggttcccgttgagatattgtcctttatagcaaaattaagcaactcatggaatctacacccctctttctctacagagcagctgagacatacatgtagaagttctcagttccctccttcatatggctaaggcactacttctagatgaaaacaggatgtgttcggttacagaataaagattttctagaatcagtgagcctcttctcacctgggaccctcacttgctgttgttgctttggtgcaatattgtacaggtgcaaaccaggttgcatcggggcagattaactgagcctatgtgtctcttcccttcccaagccctgaaaattcacatagatttacagatagtgcaaaacaacaagttttctcctgggaaaaggctggaatccttcaaatttcaatttatatgagcttaaaggtatataagtcatggggctcactgacattaggtattcatgctgtttgaaagagaaatgtctaaatgcccgttttcagtctgtttgtgtagctgagccctaacttgtacacaagttttcttgttatggagctaaattctctcagtgcctgtattactcctcagttatatgttaggccgagctccactaaagccatctgaactccagggcacttgtttttatcaggttacttactcaccggataatggaaattggcttattttcaattttacaattgactgatgaatgtattggtggtaattgatttatttcttcacttttttttgctactaaatgattttttcttttttaaaattattattattattattttgagatggagtctcactctgtcgcccaggctggagtgcagtggcgccatctcagctcactgcaagctctgcctcctgggttcatgcaattctcctgcctcagcctcccgagtagctgggattacaggtgcgtgccaccacgaccagctaatttttttgtatttttagtagagacagggtttcatcatgttaaccaggatggtctcgatctcctgacctcgtgatccacctgcctgggcctcccaaagtgagccactgtgcctggcccagtaagtgcttttttcttttggtttttccttctaacactgctcagaccaagacttacatttataaagagcaaatatattctgacctttcccctcaaagttgtattccatctagaatcaaggaaacaaatgcaaattcatcatttggggaaagcagacctcttgacagtaattcaagtccatggctatatgctaacccttgctactcaaagtgtggtccacagaccagcagcgttagcatcatctgtaagcttgttagaaatgcagaatctcaggccccacatcaaaccttcttcatcagaattggccttttaacaaatccccaggtgacctgtatgcaccagaaatattgataagcactggcctcacctcaccgtagtgataactaacctcgttaataattagagaatgaagctatctcttccttgagtctcatttacagaattatttgaagatgtgaaggtcctgaatgatcataaggattaaaaaaatgcatctttaaattccacttgaggttatataacttggatggtctacatcaaacataataaagtcaataagagatagtctttttccggtcttacctaaatagcactccatatccttgagccacctcaaagcccccatttttaagttttagtctttttttttttagaccagactagcaaagccatcagaatatcaggtggaacctcagggcaggtcctctggaaggctacaggagtctctgcttagcatagtacagaaattgttgtgtttctcgatccttgtgttcttcccttgaggaactcagcatctcaccagtaagaactcccctcccctagaggaaaatagcaagagaagttagtttaaccatctagaaacattgctaatctccttgaaagccaattctcttactcattgcaccaacaagaaacactccaaggtgggcaaggaaagacgtgaattctgatattggcgccataactcgatatgtacccagaaacagttatgttctaaattaatggctttaacctgttcattgtaaaaagtgccttggacttcaatctaaagaggtcagtataaatatgtatgtgtgtgtgtgacgtgtatgtaggcaaatatttacagatttatacatacataggtgcacacacatatacccgcacattcatatataatatatacatacatatataaatgcttcataatatatcatattgctattcacagctccatttcttttgtctggtcctatgtttatttgtttagtgagacctttacatagagaggttctattcggaacattgatgtattttttgtttgttttttactttttattaaaaaggtaaaggatattaaaaaaaaaaaaaaaagtcaagtgcctgaaggttttgaatggagttacggtaaactttctcaggtcaccaaagaggaaacatttttcctttggaaaacatttttctgtttcagtgactttgttttcccttggtggtaatgcataaataagagtggttaaagtgattttgtaagttttatttcaatccatttctgtggttcccataaggcaatagctaaaaatttgttcagtctagtgcccagttttctccacacatcagcatcagaagggcccggtcttcacatgctctgtgtggttttgttcgcgttgttactgtgttccttactaaggaaaggcaaatgaaattgcaggggctggagcttagaccagctccaaatatggcttccttttggtaacacacacagaaggtggactagtgggaagtctctctccctgaagcaggtgggaacctgtgtcttagaaggcagaggagtcccagtgaactctccacagctccatgggccctgcctgtctacagttatacaactgcctgtatgagtcagcctttctctaccttagccaaaggtcttctctttctgtggtgtgacagcttgtaatgaaccaacttgctctggttagaagtccctagagctccaggaagagtcgccaggtttccattgctgtgctcaaagctcaaggacacattatacttctttaaaccaactaaatctctctagctccctgcccccatggtgacactttcataataggcagggccaagtcagagaggtcatgccctgtatacagtgtcaatcagaagagacactgcaaaatgtcagaggtgaccagaaagacaacagatctctccagctgtcctcacagctgcaggcacatttgtggaattgtgagtaggaaggcttggcagccaggggatgggaaatgaatttccccaagttgaaaaccctgtacccttactttccttcccataaatttttctgtagttctaggtaaataataataataataaaaatgcaaattaggtgctttagaaggagtatgtaatatctgggactttttctaagttggtagacctaaaaaatgttttcaaaaatatatctagctgcatttctactgctgtcattccttaaagctcttcctccaaaaactccatatgaatgaatacatttaccaactcagtgattactaaataatagtactttatacttatacacagtaatacctttcatctaaggatctcaaatgccaatatattagtcatcaccctgtaaggtggatgacatattattcccattattccaatgggaaaattgggccatagaaaactgaggagcaaatgactcatctacaggaattaaatggaaaaaacaggctaggatttctcagcacactttaggagtgaatgaaaacttacaggcttcagttctactgctggccaccattggatttgtaagatccaggatgtgtattgaccacatgtgtccagacccaggcttagggcatctggaatgagagtggtgggctggtgtgtgggtctgaggatctggatgggagactgcattttcttctctgtgcaaaatatggaagtgtgaccttgaaggtgggcttagtctatggccttccccactcctgcttgaactgaagctggagagaatgggcatttttaaatgttacggcatatgctaatataatattatggcattaaataaaaacaagaagagaactgact

SEQ ID NO: 168029 - DNA, 2240 bp, Homo sapiens
  Payload ID: 13052
  Gene Symbol: KCNN4
  Gene Name: potassium channel, calcium activated intermediate/small conductance subfamily N alpha, member 4
  Uniprot ID: O15554
  ENST ID: ENST00000262888
  CDS Start-End: 397-1680
gtccttcggtgtctgggtgtggtgagtagaggtgtgtgtcacaaagtacagaccattgtgtgtgacaaagcccatcgtgtgtctgtgtgtgtctttatccacgtggatggacgtctctttcttgctctgccccaagacacaccctagcccctccttattctcaaaagggggagctggggagcctccccctaccctggggcctcccctgcccctccccgccctgcctggccgtcaccactccccagagggcacagggctctgctgtgcctcagagcaaaagtcccagagccagcagagcaggctgacgacctgcaagccacagtggctgccctgtgcgtgctgcgaggtgggggaccctgggcaggaagctggctgagccccaagaccccgggggccatgggcggggatctggtgcttggcctgggggccttgagacgccgaaagcgcttgctggagcaggagaagtctctggccggctgggcactggtgctggcaggaactggcattggactcatggtgctgcatgcagagatgctgtggttcggggggtgctcgtgggcgctctacctgttcctggttaaatgcacgatcagcatttccaccttcttactcctctgcctcatcgtggcctttcatgccaaagaggtccagctgttcatgaccgacaacgggctgcgggactggcgcgtggcgctgaccgggcggcaggcggcgcagatcgtgctggagctggtggtgtgtgggctgcacccggcgcccgtgcggggcccgccgtgcgtgcaggatttaggggcgccgctgacctccccgcagccctggccgggattcctgggccaaggggaagcgctgctgtccctggccatgctgctgcgtctctacctggtgccccgcgccgtgctcctgcgcagcggcgtcctgctcaacgcttcctaccgcagcatcggcgctctcaatcaagtccgcttccgccactggttcgtggccaagctttacatgaacacgcaccctggccgcctgctgctcggcctcacgcttggcctctggctgaccaccgcctgggtgctgtccgtggccgagaggcaggctgttaatgccactgggcacctttcagacacactttggctgatccccatcacattcctgaccatcggctatggtgacgtggtgccgggcaccatgtggggcaagatcgtctgcctgtgcactggagtcatgggtgtctgctgcacagccctgctggtggccgtggtggcccggaagctggagtttaacaaggcagagaagcacgtgcacaacttcatgatggatatccagtataccaaagagatgaaggagtccgctgcccgagtgctacaagaagcctggatgttctacaaacatactcgcaggaaggagtctcatgctgcccgcaggcatcagcgcaagctgctggccgccatcaacgcgttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggacccacgaggaggaaccaggctactttccccagtactgaggtggtggacatcgtctctgccactcctgacccagccctgaacaaagcacctcaagtgcaaggaccaaagggggccctggcttggagtgggttggcttgctgatggctgctggaggggacgctggctaaagtgggtaggccttggcccacctgaggccccaggtgggaacatggtcacccccactctgcataccctcatcaaaaacactctcactatgctgctatggacgacctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccagaa

SEQ ID NO: 168030 - DNA, 1190 bp, Homo sapiens
  Payload ID: 13052
  Gene Symbol: KCNN4
  Gene Name: potassium channel, calcium activated intermediate/small conductance subfamily N alpha, member 4
  ENST ID: ENST00000600909
  CDS Start-End: 1-180
gtggacatctccaagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggtgagggggctgggacttgggcaggaaggcatcctggaggaagggttcctgtggccagcaccctatgtggctaagggggcgggggatggctgggagacaaggccgccttttctcatcagctctggcactgtctggaggaaaggactcagttcggggctggactggcagtgaaggaagatggtgtaccctctccccttcactgacccttgatggccttctccctctttgcttggtctctctctctctctctgcctgtcctgggcacattgtctggctgtccatccaatgtctctgtctaaatgccctcctgccccctggcctcggggcccggaaacacctgccccctgtctcccacttctgcccaccggtttctgtctgcacctcggtgtgtcccactctcactctccctcttcctggcctgcctctccatcagtctctctgtctctccaggacccacgaggaggaaccaggctactttccccagtactgaggtggtggacatcgtctctgccactcctgacccagccctgaacaaagcacctcaagtgcaaggaccaaagggggccctggcttggagtgggttggcttgctgatggctgctggaggggacgctggctaaagtgggtaggccttggcccacctgaggccccaggtgggaacatggtcacccccactctgcataccctcatcaaaaacactctcactatgctgctatggacgacctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccagaa

SEQ ID NO: 168031 - DNA, 1003 bp, Homo sapiens
  Payload ID: 13052
  Gene Symbol: KCNN4
  Gene Name: potassium channel, calcium activated intermediate/small conductance subfamily N alpha, member 4
  ENST ID: ENST00000598836
  CDS Start-End: 1-496
tgtctgctgcacagccctgctggtggccgtggtggcccggaagctggagtttaacaaggcagagaagcacgtgcacaacttcatgatggatatccagtataccaaagaggaaggagtctcatgctgcccgcaggcatcagcgcaagctgctggccgccatcaacgcgtgagggccgctttgtatgcacacgtgtccatgtgcacccatgtccaagtcacctctctgcacggctgtgtgtgtgcatgtccatgcctgtccaggttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggacccacgaggaggaaccaggctactttccccagtactgaggtggtggacatcgtctctgccactcctgacccagccctgaacaaagcacctcaagtgcaaggaccaaagggggccctggcttggagtgggttggcttgctgatggctgctggaggggacgctggctaaagtgggtaggccttggcccacctgaggccccaggtgggaacatggtcacccccactctgcataccctcatcaaaaacactctcactatgctgctatggacgacctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaa

SEQ ID NO: 168032 - DNA, 648 bp, Homo sapiens
  Payload ID: 13052
  Gene Symbol: KCNN4
  Gene Name: potassium channel, calcium activated intermediate/small conductance subfamily N alpha, member 4
  ENST ID: ENST00000600408
  CDS Start-End: 1-342
tcagacacactttggctgatccccatcacattcctgaccatcggctatggtgacgtggtgccgggcaccatgtggggcaagatcgtctgcctgtgcactggagtcatgggtgtctgctgcacagccctgctggtggccgtggtggcccggaagctggagtttaacaaggcagagaagcacgtgcacaacttcatgatggatatccagtataccaaagagatgaaggagtccgctgcccgagtgctacaagaagcctggatgttctacaaacatactcgcaggaaggagtctcatgctgcccgcaggcatcagcgcaagctgctggccgccatcaacgcgtgagggccgctttgtatgcacacgtgtccatgtgcacccatgtccaagtcacctctctgcacggctgtgtgtgtgcatgtccatgcctgtccaggtcaggacacccaggttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgag

SEQ ID NO: 168033 - DNA, 983 bp, Homo sapiens
  Payload ID: 13052
  Gene Symbol: KCNN4
  Gene Name: potassium channel, calcium activated intermediate/small conductance subfamily N alpha, member 4
  ENST ID: ENST00000599720
  CDS Start-End: 116-289
cccagagccagcagagcaggctgacgacctgcaagccacagtggctgccctgtgcgtgctgcgaggtgggggaccctgggcaggaagctggctgagccccaagaccccgggggccatgggcggggatctggtgcttggcctgggggccttgagacgccgaaagcgcttgctggagcaggagaagtctctggccggctgggcactggtgctggcaggaactggcattggactcatggtgctgcatgcagagatgctgtggttcggggggtgctcgacacactttggctgatccccatcacattcctgaccatcggctatggtgacgtggtgccgggcaccatgtggggcaagatcgtctgcctgtgcactggagtcatgggtgtctgctgcacagccctgctggtggccgtggtggcccggaagctggagtttaacaaggcagagaagcacgtgcacaacttcatgatggatatccagtataccaaagagatgaaggagtccgctgcccgagtgctacaagaagcctggatgttctacaaacatactcgcaggaaggagtctcatgctgcccgcaggcatcagcgcaagctgctggccgccatcaacgcgttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggacccacgaggaggaaccaggctactttccccagtactgaggtggtggacatcgtctctgccactcctgacccagccctgaacaaagcacctcaagtgcaaggaccaaagggggccctggcttggagtgggttggct

SEQ ID NO: 168034 - DNA, 2029 bp, Homo sapiens
  Payload ID: 13052
  Gene Symbol: KCNN4
  Gene Name: potassium channel, calcium activated intermediate/small conductance subfamily N alpha, member 4
  ENST ID: ENST00000615047
  CDS Start-End: 582-1469
gtccttcggtgtctgggtgtggtgagtagaggtgtgtgtcacaaagtacagaccattgtgtgtgacaaagcccatcgtgtgtctgtgtgtgtctttatccacgtggatggacgtctctttcttgctctgccccaagacacaccctagcccctccttattctcaaaagggggagctggggagcctccccctaccctggggcctcccctgcccctccccgccctgcctggccgtcaccactccccagagggcacagggctctgctgtgcctcagagcaaaagtcccagagccagcagagcaggctgacgacctgcaagccacagtggctgccctgtgcgtgctgcgaggtgggggaccctgggcaggaagctggctgagccccaagaccccgggggccatgggcggggatctggtgcttggcctgggggccttgagacgccgaaagcgcttgctggagcaggagaagtctctggccggctgggcactggtgctggcaggaactggcattggactcatggtgctgcatgcagagatgctgtggttcggggggtgctcgtgggcgctctacctgttcctggttaaatgcacgatcagcatttccaccttcttactcctctgcctcatcgtggcctttcatgccaaagaggtccagctgttcatgaccgacaacgggctgcgggactggcgcgtggcgctgaccgggcggcaggcaacgcttcctaccgcagcatcggcgctctcaatcaagtccgcttccgccactggttcgtggccaagctttacatgaacacgcaccctggccgcctgctgctcggcctcacgcttggcctctggctgaccaccgcctgggtgctgtccgtggccgagaggcaggctgttaatgccactgggcacctttcagacacactttggctgatccccatcacattcctgaccatcggctatggtgacgtggtgccgggcaccatgtggggcaagatcgtctgcctgtgcactggagtcatgggtgtctgctgcacagccctgctggtggccgtggtggcccggaagctggagtttaacaaggcagagaagcacgtgcacaacttcatgatggatatccagtataccaaagagatgaaggagtccgctgcccgagtgctacaagaagcctggatgttctacaaacatactcgcaggaaggagtctcatgctgcccgcaggcatcagcgcaagctgctggccgccatcaacgcgttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggacccacgaggaggaaccaggctactttccccagtactgaggtggtggacatcgtctctgccactcctgacccagccctgaacaaagcacctcaagtgcaaggaccaaagggggccctggcttggagtgggttggcttgctgatggctgctggaggggacgctggctaaagtgggtaggccttggcccacctgaggccccaggtgggaacatggtcacccccactctgcataccctcatcaaaaacactctcactatgctgctatggacgacctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccagaa

SEQ ID NO: 168035 - DNA, 6875 bp, Homo sapiens
  Payload ID: 13053
  Gene Symbol: KCNMA1
  Gene Name: potassium channel, calcium activated large conductance subfamily M alpha, member 1
  Uniprot ID: Q12791
  ENST ID: ENST00000286627
  CDS Start-End: 954-4490
ccgggccgctgccgaggggccctgcccacccctgcccagcccggagcccaggcgagccagcgcggcgagcctcctcccctcccgcctgggtcgtcctgagtccgcgcccgctccagttgctgcagctgctgctgctggcggctgcggggagcgcggggcgcgcgccgaagaggcttgggcggcgaggacggggacgaggaggagtcggaggcggcaaggaggaagagcgagcggaggccgaggggctcagcggcgtggcgacaggactagggggtcccgagaacatgggctagcaggcggccacgggccggcggccggacgcggtgaacctgccgcggccgggcgcgcactggcgcggcgagccggagccgagcgcagccgggggaggagggctggcgcaggggcgcccgggcggagggggccgattatccattattaacgagttaccacctaataagcggagagcggctcgttagccgcgcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaat

SEQ ID NO: 168036 - DNA, 6100 bp, Homo sapiens
  Payload ID: 13053
  Gene Symbol: KCNMA1
  Gene Name: potassium channel, calcium activated large conductance subfamily M alpha, member 1
  Uniprot ID: Q12791
  ENST ID: ENST00000286628
  CDS Start-End: 1-3711
atggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaatttta

SEQ ID NO: 168037 - DNA, 5732 bp, Homo sapiens
  Payload ID: 13053
  Gene Symbol: KCNMA1
  Gene Name: potassium channel, calcium activated large conductance subfamily M alpha, member 1
  ENST ID: ENST00000354353
  CDS Start-End: 129-3344
aggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcgttgggaagaacattgttctttgtggagactggaaagcaagggaaatgtgagaagattaaactactgcaggggtcagcaaactttctctgtcaaagtcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaatttt

SEQ ID NO: 168038 - DNA, 3548 bp, Homo sapiens
  Payload ID: 13053
  Gene Symbol: KCNMA1
  Gene Name: potassium channel, calcium activated large conductance subfamily M alpha, member 1
  ENST ID: ENST00000372403
  CDS Start-End: 1-3548
cttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagcagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttga

SEQ ID NO: 168039 - DNA, 3646 bp, Homo sapiens
  Payload ID: 13053
  Gene Symbol: KCNMA1
  Gene Name: potassium channel, calcium activated large conductance subfamily M alpha, member 1
  ENST ID: ENST00000372408
  CDS Start-End: 1-3504
cccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttc

SEQ ID NO: 168040 - DNA, 3729 bp, Homo sapiens
  Payload ID: 13053
  Gene Symbol: KCNMA1
  Gene Name: potassium channel, calcium activated large conductance subfamily M alpha, member 1
  ENST ID: ENST00000372421
  CDS Start-End: 1-3457
caatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttc

SEQ ID NO: 168041 - DNA, 3788 bp, Homo sapiens
  Payload ID: 13053
  Gene Symbol: KCNMA1
  Gene Name: potassium channel, calcium activated large conductance subfamily M alpha, member 1
  ENST ID: ENST00000372437
  CDS Start-End: 1-3516
atggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttc

SEQ ID NO: 168042 - DNA, 4157 bp, Homo sapiens
  Payload ID: 13053
  Gene Symbol: KCNMA1
  Gene Name: potassium channel, calcium activated large conductance subfamily M alpha, member 1
  ENST ID: ENST00000372440
  CDS Start-End: 352-3885
ggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttc

SEQ ID NO: 168043 - DNA, 4617 bp, Homo sapiens
  Payload ID: 13053
  Gene Symbol: KCNMA1
  Gene Name: potassium channel, calcium activated large conductance subfamily M alpha, member 1
  ENST ID: ENST00000372443
  CDS Start-End: 728-4345
gcgagcggaggccgaggggctcagcggcgtggcgacaggactagggggtcccgagaacatgggctagcaggcggccacgggccggcggccggacgcggtgaacctgccgcggccgggcgcgcactggcgcggcgagccggagccgagcgcagccgggggaggagggctggcgcaggggcgcccgggcggagggggccgattatccattattaacgagttaccacctaataagcggagagcggctcgttagccgcgcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttc

SEQ ID NO: 168044 - DNA, 5639 bp, Homo sapiens
  Payload ID: 13053
  Gene Symbol: KCNMA1
  Gene Name: potassium channel, calcium activated large conductance subfamily M alpha, member 1
  ENST ID: ENST00000406533
  CDS Start-End: 129-3251
aggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaatttt

SEQ ID NO: 168045 - DNA, 4125 bp, Homo sapiens
  Payload ID: 13053
  Gene Symbol: KCNMA1
  Gene Name: potassium channel, calcium activated large conductance subfamily M alpha, member 1
  ENST ID: ENST00000404771
  CDS Start-End: 117-3983
ggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttc

SEQ ID NO: 168046 - DNA, 3173 bp, Homo sapiens
  Payload ID: 13053
  Gene Symbol: KCNMA1
  Gene Name: potassium channel, calcium activated large conductance subfamily M alpha, member 1
  ENST ID: ENST00000404857
  CDS Start-End: 129-3173
aggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatga

SEQ ID NO: 168047 - DNA, 994 bp, Homo sapiens
  Payload ID: 13053
  Gene Symbol: KCNMA1
  Gene Name: potassium channel, calcium activated large conductance subfamily M alpha, member 1
  ENST ID: ENST00000450795
  CDS Start-End: 1-793
agtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctggccggttctcaggatactcatcctgacagcttctaccaccaggcagtgaatgcttcctcttacctccatggtggagggcagatgtggccagttagctcctcatcttccatcctcctccactatctcaggcgacagatgccagggccagcccgccttccacttgagctttcttgtcaaggctctgccttgagcccaaatcctgacctttactgtatgaaataaagtactgatgaacaagcagaggtttgaattagagcaggcttggagcaaatgtcaagtccgtctctgcctctttcctccacctgcaccaggagcctcgattagacccagtgtggagtttgcagcgccttaggctttatgggtctggggagacataacttattaacaaagagttattaaatttttatcaattttacaacacaa

SEQ ID NO: 168048 - DNA, 3902 bp, Homo sapiens
  Payload ID: 13053
  Gene Symbol: KCNMA1
  Gene Name: potassium channel, calcium activated large conductance subfamily M alpha, member 1
  ENST ID: ENST00000457953
  CDS Start-End: 1-3630
agcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttc

SEQ ID NO: 168049 - DNA, 3090 bp, Homo sapiens
  Payload ID: 13053
  Gene Symbol: KCNMA1
  Gene Name: potassium channel, calcium activated large conductance subfamily M alpha, member 1
  ENST ID: ENST00000434208
  CDS Start-End: 1-2659
gaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtcttccttcacttcccccattgccaccccccaatcccagtccccccatcggtctgttcacatctctgtgttcatcttggcaagacctactcaatcaagtgatgatgccagttgataaacttccctggaaaacatttacagctattccatttggcaaacttgcttctctgtcaatatttcatcctcctttaaaccaggagggttattaatggcaaaagcattggtcttctttatgcttgatcagtatgactcaaattaaaagtgttctgctgtgtatatcaactcagtagcccacacccagttatctgggagctgatggttcagtcactgtattacccaaatctttcctgccagctgcctttcagacatttgttaaatcccaaccagagaccgggcagatagagagaagtaaatccgaagtgcgtttt

SEQ ID NO: 168050 - DNA, 826 bp, Homo sapiens
  Payload ID: 13053
  Gene Symbol: KCNMA1
  Gene Name: potassium channel, calcium activated large conductance subfamily M alpha, member 1
  ENST ID: ENST00000428546
  CDS Start-End: 1-542
cgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagacctcctcaactctgtctccctttggctgcccagaaaaggtgctttcagagtgacaagcttgatatttttatttgactgagaaacgacatacttctgccccctcaaatatatatttgaccagactgtgggaattttggtgttgtatttaacttccccaccaagggcccagggctcattgcccacatgtccccacgagtagcatcaaaggctgttctcaaaaatgaaagacgaatgagcagacacagtgtgtcacatcagcaacttttttcccagtttctttgtaaatggaagtttatgaaaaggagcactaactcaaatcacagaatcctgtgtttgaaataaatggtcttgcaacaaac

SEQ ID NO: 168051 - DNA, 11397 bp, Homo sapiens
  Payload ID: 13053
  Gene Symbol: KCNMA1
  Gene Name: potassium channel, calcium activated large conductance subfamily M alpha, member 1
  ENST ID: ENST00000604624
  CDS Start-End: 1-3129
ggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatccagaaaagaagactaaggggacaggtgaatacctgctcctcgcctggatgggtgtgtattttgatctgcattgacaccagctcttaataaatggaaacttatttattttcacagttgaaagtcatatttttgtagttctagttttcattctgtagttctcacccctttgttcatatttttaaagggaagaccttctgctgcttttctacaattggcagatcaggtttgtctggccaactaaggacaccaggagggttgtgggcacacctgggatgtggaagctgaggaccagatgcacacaaggcattgctctgtttgctgttctagtggtggagactcctacgtgctgttatgcttctcattttatatttccaaaccacctgagcgagtaatgtcaacttcgggagggtctggtggactttctccccactccccaagtctcagagcttttagcctggaagtttgtaaaactgattagtagttttactttaccataggatgtgagagggcagtcattcttctcactgagtttttgtttaaaaaccaggaaatttctacaatcatggagacagattttaatttgcatgctctcctttatttagttgctggggccaaacacatgaacttgttacaacaatttaaaaataataataacaaaaggaaagcaacgaatgcacttcatatagactgttagaaaaggcctttgaaaattaccagcagtgaaatcaaataaattagccactttaaactgcggtcaaaagatttttctagccatcagatgcaattacgatgtctcagagctctgctatcgcttgcatgctcggtgtacagtctcccggcaactgttttgttccaatcaacttagcaagtctttcaactttaaaattatcaatctttgatatgatcatcaaggtctctggagaagcatggatgtaatagtgatttctattttcttaaaaaatgtaaactgtggacacttaatggaaccaagctaaccaaagtatctccccgaagtttcatgatatctagtccattaactctttgggccatgacctgtggtacctagttatggtagtgcaaatcagatcagagcaaagcaatgagatcatcatgaagacatatgtccactaagtactccaattaccagcgtaggcaaaatgagcttccacctctgtccactccctgcagagccaatatagtcgtgcttccacctcgtaggcattgtcctgcagtgatttgtcggactgtggttactctgtcgtcacattttgtagaattagttctataaaagtattgtgaatacaatgtatgtccaattggattgtttaaaaactacttataattaatcactagcctactcagcagactaaaatgatgtcaacagtctatattcaggcttataaacatttcttggtttccaacagaagtcaaatgtgtttgtggggagaacgttttgctaggattttgacaactttcctgaaagctaggccttttttacataatgattttgcattggggtcaccttagtatattcacgtcaatccacgctcttctttccttcgtgaaccatagtgggctcttcactcctgctcgtaataaccacctccaaatttgttagagtgatttggtctcctctggcaggctgtggtggccacataaaggatcttccattagagggacacaggacacaaagctccattcccatgaccctctcttccctgtgtctcccctaacaaggcaatctggaagcagaaatgcaaactccagccccaccacacatccaccgatgcatttgtggctagaaattttaatctaaactttttttaaaaaaaatcataatagttaggatagtttcctatagcaaagggctccttgattcataagcacctcccccccaaaaaaaccaaattggtaaaaattcattttcttttaaatagagcaataagttcatactgtgttgccgttgtaataatgaattgttctggactagaaaacaaaatgaggcattttgttaagggggtaggaaaatgactgattgttgggccctttggcaaaagctggtgcctggtaagtagaaacgaaatggaaacagaaataacatttgtgaaatcactggagggctcaagcaaatgccagagcttctccctggcttgttcctacttgttgagctctttggccctgagtcccatccatctccactgcaacagtctgtctttctgcctacatccgcctgagaccaaggagggtctttggtacagtccacattatgaggctctgatttcctatcccagtttagggctccagaaaagccattctcccaaactaatgattcttgggtgctgtgggtcaccaacaggctgtttacaaagcagaaaatatcatcaccatcataacctttctccttgagaaaacttttatttttgtctaagcaattttatattttagaatatcatcttgaaccattataaaacaccttaaataaaagtgattgtgactaaggcacgttggagaacattccaatctttcctcccaagggttctggcaccttatgatgtactttgtaaaaaaattgattgaagattttaaataaacaggaaattagaagtgttagggttagataaaggaaaagtgaaaaagcataagaaatttgggactttttcatgttgaaaggagaaaaagcacaagttccctagttaccatttaatatgagggtgcaagagccacatttacaaacaacaaacttgatctttaaaaatgtttttaaaactctctgagtctcagtgacttcatttgtaaatgagagtgattcatctagatgactctaaggtctctttcaggtcccaggggacgtgatctaagttaggagtgggaacatgggagtggctgcttctccttggctaagcccatgcagactattgtgtccaggactggaataaaggtcctttttgctgcatcacccaggcaacactcccagccttactcaggagtggtgaacattttctgctctggacatagaataggtaggttcattcctggtcttttcactttagattctctttaggttcaagatgcagatttctcaatttggacacacctgcatcacgttggtcaaattttgctgcctgtttctagggttttcttctcagtttcatccctgccttcccttttttgttgttttttttttggttcaaggcccagcttcagttaatcccttcatctctatgccatgtctccaattcctagtatgtaactagaggttcaagagaccccaaattcctgccattttccccatttatgtttccccatgtgaatcttcaggaagtaaccagtcttccttctcacttcatttcctgtcctctgtttatttggttattttctttcattaataaactaaccatctcttagctacttacattcacaaatgtaattttaatctattgtgtttcattgtgaaagagaatctcattgaaggaaggaaggaagaaattgaggaataaaggtaggaagggagagaaacaaagactatccaaccaattgactgagatgtgagccggcttgactcctaggagactaagtagatccattcagcttgaacactgagttccagggcagaatctgtccattttctgttttgttcttacttgctgcttttggaatggtggtaaagccaccagtcaccatgagccttgaaaggaccttcactaatgaggacttgactcaccctctttaaaaagcaaaagaaacagaatttacttacaatcttctggtaaattacctttctgatcctctccttattcccaaaaggcaatttttttaatccagcagagatgatttagcatataaatcccaggtcatttgaggaggtgatgacgctatttggatttatttatgagacagtagtaattataaatgattcctaggcagtttgtactagtttggtcatattggttgtttaagtggagtctcttctgattgtttgtttccaataaagtatcagttgttaataatttcaagatttccataaaaataagaaaacttggaaaacatttttaattttatttcttaagagaccacagagcctaattttcaatttttatggtaagcttgcttaaaacatgtataaaaagaagcctacatgctcaaaggcagaggcacctttagccctacaacagttggaagctccatgatatcacagccccacatggatagattggagaaagaattctgacttagaccacctgtagcagaccttcctcttttggcatatttttttaatcacaaaaaggacctgagactccctatctaaagataagccaaacttggggtatacattaagaatctgggaagaaagaaaaaaaagaaaaagatataataagcagtattttaaaataccatgagttatgggcatgcatatggtacaaagagtagttctttgggttgaaagaaagaagagtttgcattgaactgcgtaggctggcaagaatgcagaggtatacaatgtttgatgggctttggaggcatttcaatagtaaatgggtgacaggactggaaagatgtggaatatgagggttttccagggagatgggacttaatgggccatgatgtatttgtaggaatgtgatttcaatagattgactattttgtctactgtgataagtttgtgtaggggaactgaggaaaactgagatgagacttcatggaaggggctacaaagtacagtctaaaggcctagataaagtttgaaacttgatttagaaagtcatgaaaagccactcagagttttaagcaaagagtgatggggcagcaatggctgtgcatttttcaggttgaaagtagtgagatgtcagttcttcctggaagatatcatgagaatgcacacaaaactgaacattttctcagcagcaaggagtgctaaagggtgcacactccaagtcaacaactcaccgtgtgcagcaccttcctcacacattttgctttgctttctgtcacaggaccatcagacgtagaacgtcctgactctcctgaattactagaatgtcagcaacaaactcacaaagtagattagagggtaggaatagatacataaatttttaaaaacctgccaatcatactgttttctagacagtaatataataagaacatgaggcaggacatccacaaatagtagagaataattaatagtccagaactgccaaataggaattccccttatgaaaacacccttgcagctaatcaggtagcccttgtttagaaaccaattagcactcataaaatatttgtacaaggagtgagtgggggagaaatgagcacaatatgggttctgccatcaatcagcttataatacaactaaagaaagaaaacatgctcaaagcaccattagagaaagggtgagccctaatgacatagtttcacattcaatatggtaggagttgaaacaagggagaaatgctgtggtttgaagtggttcaacaaggtaggatttctagagaaaggggggtttaggagttagataagtagaggatcagcattctaggtatgaaggcaggattatctggcatgtggcagggtgaatgatgttaatcagtaactgctaattgatatttactgagcagctgctgtgtcctcacgatggtaagactattagaggaagacagcccacctgcctaactgggaacacaaggcacacatatattggaaagatcatgttgcacaaaacaggtgttcaataaataatttttgaataaatgtgaacactgaatagcaaataaatgttatagatcgtaatagttgtagaagattggttgggattgtagggactggatgtggggcaatggctgtgggtctagagtatattcattgtgcagtggacacacacctaatctgtcctcaaggacagaaccatgtggaggaataggaaaacaagagaagcaggcaagaagcggaggcagtgagtacagcagctaagaaatgttacattgggttcatccagagcaagaaaagctgagagctgtccgtgagggaaggccacacaggcaagaggagtgggacaggggagtaaaggagtgggctacaacaggccctgcagatgtggaagccagacccacagaggcacttagaaagtgaggatcctggatgaattattttagggagaaagtgtaggtttagatcagctggcagatgtgtttgtgggctacagccaagtttttcaggactaagaaggagcaaaataagtagaacttcttgggacaggagatctagggtactccagaaccagggaaatgagaaacaagaggggaattttaagaaagagagggaagatcatctatgaggttggagatgaaaggtgttggagatggtgaggcacaagtcaaaagactcactcgaagggcaggaactctgcttatttgtccatattcccagagtttgtcatgaggtctggcccacgtgggcagtcactcggccactatgtatcactgtggctgccatggtggatggaggctggacagaacctgtggtgatcggcagtctttctggaggactcaccagggaggggtctcagggtgggcatctcctttcaccttcctgtgcatgtcactgcactgttcttcttccctccctgaacagcacacacactgcatccttagtttcaggggtctgaaaacaaatgctacgaccaccttgctttggtggcttttctgaacaggcattgtgagaagagatgttctggccaggtgaaagtggactttatttttaggtaggtttttcagtttagaaaggtttcctttgcttatcccttgaggacttctgtgctgctgcttctcctccatcttgctagttaacagaacaggggcagaagtgacaccaatgctctcggccatgcctgccttgggaagcactaccgggccccactgtttagaatcttagatggaaatgtacacaaggcattgacacacgcctgcgggagtgacccagtgcttccctcccatgggactcagggtcagcgtgggaaggcagctggcagggacaggagccccgcccgcaaggtggactgagcctcacttccacacaaaaccagagtcccatctgccccagagcgctcgctctcctccccttccttccgctcaatgcagcctgacacgcctttgaccagaactgcaacatttcaaacacaaacccagatctgttgggaaatcctaattaaaaacgttgcattcccaggtggcacaatcacatcctgcctaaaacttctggcccacatcccaccacccagatgttgaaaagaaacctttctctgcttaacaccaaaacctgcacttcaaggtttctttaggggacaaagaaaaaaaaagtacacacatgcagagttcagcctacatgttcattgaggaaaaagagcgtggcttattcatctttcaatcttttgattgttggcattatgattatgattatgattaattactctgacctgacaggaattgaagaagagactatatgctggtgctctgaaatgatctacccaactctgtcatctgtaacaaccagtgataactctcttgtcttgtaaaaagggtttgtacataacttgtacatggtttcattttgtatttttcgcagattaaaaatttatgtatttgtgttctaaaac

SEQ ID NO: 168052 - DNA, 1046 bp, Homo sapiens
  Payload ID: 13053
  Gene Symbol: KCNMA1
  Gene Name: potassium channel, calcium activated large conductance subfamily M alpha, member 1
  Uniprot ID: Q12791
  ENST ID: ENST00000480683
  CDS Start-End: 352-858
ggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggccacccactttgggtccccggaaatgccaccagcagcgcggagctggagcgggagtccgcctgaggccgcggttttacgcggagcgtcttccctggcgctcgaggtggctagatgtcgtcggctttagctattcctggtgcagacgcccaccggcactgaggctggcgacaccttcgatgtatggttgctaggctcactgcctggtctgtagtcgtgtccctagagatgtcttcccttccccacagccactggctggagtgggggacccgacactgatagaaaactgcagaataaaaaagaaagaactggaaaaaa

SEQ ID NO: 168053 - DNA, 896 bp, Homo sapiens
  Payload ID: 13053
  Gene Symbol: KCNMA1
  Gene Name: potassium channel, calcium activated large conductance subfamily M alpha, member 1
  ENST ID: ENST00000481070
  CDS Start-End: 148-534
ggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggtgctctagtggaacataccccaagttcttcggcctctgttcctttgcccccaggccacccactttgggtccccggaaatgccaccagcagcgcggagctggagcgggagtccgcctgaggccgcggttttacgcggagcgtcttccctggcgctcgaggtggctagatgtcgtcggctttagctattcctggtgcagacgcccaccggcactgaggctggcgacaccttcgatgtatggttgctaggctcactgcctggtctgtagtcgtgtccctagagatgtcttcccttccccacagccactggctggagtgggggacccgacactgatagaaaactgcagaataaaaaagaaagaactggaaaaaa

SEQ ID NO: 168054 - DNA, 1357 bp, Homo sapiens
  Payload ID: 13053
  Gene Symbol: KCNMA1
  Gene Name: potassium channel, calcium activated large conductance subfamily M alpha, member 1
  ENST ID: ENST00000618048
  CDS Start-End: 178-819
cgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaagggttgttggcggctgcggctggggccggggtcggggactcacaggctcgggtgccgtggtgcggggtggggacagccaactcagcggggacggaggaagctgggggcagctgggtgcgtgttttgcaccgctcacctgccggggctcggctcctggcggtgggcgagagggagcacatccgcccatactttaggaacctgttggggagatgagttcgtggggtcagaaagaagggaaaaatcctttgggcaagggagagaataattttgcacaagggaatcccgggggaggagcatggcccgagataacagggggacttcgaggggcgagagaagttggggagatccatcccactattgggggtagcccacggggctgccacttttggaatgtgtcgaggtcgcatatctgatgtaacctcccactccgtcccttaggtgctctagtggaacataccccaagttcttcggcctctgttcctttgcccccaggccacccactttgggtccccggaaatgccaccagcagcgcggagctggagcgggagtccgcctgaggccgcggttttacgcggagcgtcttccctggcgctcgaggtggctagatgtcgtcggctttagctattcctggtgcagacgcccaccggcactgaggctggcgacaccttcgatgtatggttgctaggctcactgcctggtctgtagtcgtgtccctagagatgtcttcccttccccacagccactggctggagtgggggacccgacactgatagaaaactgcagaataaaaaagaaagaactgg

SEQ ID NO: 168055 - DNA, 3826 bp, Homo sapiens
  Payload ID: 13053
  Gene Symbol: KCNMA1
  Gene Name: potassium channel, calcium activated large conductance subfamily M alpha, member 1
  Uniprot ID: Q12791
  ENST ID: ENST00000626620
  CDS Start-End: 167-3826
gcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctggtcacaggctggatgccgtatctgggacctagggttttaatgacttgcctggatattggtgtagtatgcatgccaactgatattcaatcaacatctcctgccagcataaaaaagtttaaggagactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttga

SEQ ID NO: 168056 - DNA, 718 bp, Homo sapiens
  Payload ID: 13054
  Gene Symbol: KCNJ1
  Gene Name: potassium channel, inwardly rectifying subfamily J, member 1
  ENST ID: ENST00000324003
  CDS Start-End: 301-718
actcttgcatcaaaggtgcagggacttgctcacatcgagaatctggttgctttcttggagaccaagaaaatgagtttttgtttctacatttactccagcaatccatgaggtttcttctctactgtgccttcatccccatcctgggccctgacaaagacagtgtgacaagttctgagccccacaggtggaatcccaaaccaagcagctcttgctggtcaccccaagatctacttatacatgaagttttgaaaatcatctcctgaacctcttctgacagagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttc

SEQ ID NO: 168057 - DNA, 2614 bp, Homo sapiens
  Payload ID: 13054
  Gene Symbol: KCNJ1
  Gene Name: potassium channel, inwardly rectifying subfamily J, member 1
  Uniprot ID: P48048
  ENST ID: ENST00000324036
  CDS Start-End: 526-1644
gttgcatacagatgagttggcagccggtctgagctggcccacagactcataaaatcaacagggcctcgggtaccctcacctagcatatccaaactcttgcatcaaaggtgcagggacttgctcacatcgagaatctggttgctttcttggagaccaagaaaatgagtttttgtttctacatttactccagcaatccatgaggactttataggaattttgcaccattctgaatggatacatttggatttctcaacatttgttcagcttcctaatgactgttgtgacaattgctctataccagtgaatgccaactgtttatctctgctctgaacaggtttcttctctactgtgccttcatccccatcctgggccctgacaaagacagtgtgacaagttctgagccccacaggtggaatcccaaaccaagcagctcttgctggtcaccccaagatctacttatacatgaagttttgaaaatcatctcctgaacctcttctgacagagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttt

SEQ ID NO: 168058 - DNA, 1674 bp, Homo sapiens
  Payload ID: 13054
  Gene Symbol: KCNJ1
  Gene Name: potassium channel, inwardly rectifying subfamily J, member 1
  Uniprot ID: P48048
  ENST ID: ENST00000392664
  CDS Start-End: 118-1293
acacaaattagcgtcagtccactgactgtcgcctacaataaattaggctgagtctaaaagaaatcagtctgcatagaaagaccaacaaccagcaccacttccttgctttttccagccatgaatgcttccagtcggaatgtgtttgacacgttgatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcagg

SEQ ID NO: 168059 - DNA, 4074 bp, Homo sapiens
  Payload ID: 13054
  Gene Symbol: KCNJ1
  Gene Name: potassium channel, inwardly rectifying subfamily J, member 1
  Uniprot ID: P48048
  ENST ID: ENST00000392665
  CDS Start-End: 146-1264
acctagcatatccaaactcttgcatcaaaggtgcagggacttgctcacatcgagaatctggttgctttcttggagaccaagaaaatgagtttttgtttctacatttactccagcaatccatgagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtgcatgcactttgattattattattactatgcattaactgagtcaggttccaggtgaaaatcctcttgcagagaggaccctctcctggaaggggcgggaggagtggagaggaagcagataggacacatttgttgtctggagtcctcaggaggaaatgaccctggccacagacacaccccttccggtacagctccatcacgcctctccagtgtgagtcttggcacataaaacggcagctgcccacagttgttgggagggatggcttatgtttttccatgcctgggctgtatttgtacagatccatgcaccactctggtccttctgactaagaacagtgggaagtctgatggttttagggttgcacaccttgtcagtggccataacagtggccatagctggcccatgtggaactctcactctgtacctgtgagtgctttggcaccacaatttaatgtgctgacaggaaaaagaaatcaggtatcacaagcttgagggagctggaattctctgctggcccactgtcatgatgtagccccttcataaactggagggaaactgtgttgacacttgttcccatcagcatgcactcttcctggtgtattctcctgctggctggcagcatgcatgtagatggctggaagtgagatggtcataagcaatccattccctttgattgtttagggaggtgaacaacatacatctttctgattggtatttacttctgggttatttggtggaggcccatctgcttctaaatatccctttgctaggatcaagacactctgcacctggagtctcttttttaatggaaattcccattgaccctctagcaaccattaacacaggtacatccaattaagcccctaggaaaagaggcctggaacaggtaacttttgataggtctaaggagtggctggaaccccaaagcgcataacactcctgtgcattttaagaaagggggtaacaagggaatgggtgctcaagtagtaaagagaaatgaaaaatagcctgagaaggccaaactgcttgtaggttaacaccactgctaaaggcagcctttttattacaatgcagtgacatttttcccggtggaatctgactacatcagtactgctatttgctacagatgctgggttattctatttgctgatttcaaaagcatgtcaactgttctaatttccttcgtgaaaaactgcatcccatgatgcattattatattcaaaattttccttgagactgattctctttgaattgcccagttcatctctgttgctatggggattttgactaagagcgtttgatcctggttgaatcttcctggacttaggttggctcaagctccaatatttaagagttaagatttgggaggttgtctttaatggaaagcactaaatgtttaaaaattatttattccttaagagagaaaaggtagaagggaaagatccttttgtgttgccatgcctttttaagacatgggctgataggtgactgtccttctctatccatcactaaggggatgtgcaactggaccttccagaagaactccctgggcggattgcagagacggttgaggaagtgtcttccttggggatttttcatgaaacagaatatgggtcctcaacaggatgcttctgtgaatagcacggggatctttccctgtctagaacaaacgttaggacagcttctgatggaaagaatgcaaatgaa

SEQ ID NO: 168060 - DNA, 2621 bp, Homo sapiens
  Payload ID: 13054
  Gene Symbol: KCNJ1
  Gene Name: potassium channel, inwardly rectifying subfamily J, member 1
  Uniprot ID: P48048
  ENST ID: ENST00000392666
  CDS Start-End: 393-1511
gttgcatacagatgagttggcagccggtctgagctggcccacagactcataaaatcaacagggcctcgggtaccctcacctagcatatccaaactcttgcatcaaaggtgcagggacttgctcacatcgagaatctggttgctttcttggagaccaagaaaatgagtttttgtttctacatttactccagcaatccatgaggtttcttctctactgtgccttcatccccatcctgggccctgacaaagacagtgtgacaagttctgagccccacaggtggaatcccaaaccaagcagctcttgctggtcaccccaagatctacttatacatgaagttttgaaaatcatctcctgaacctcttctgacagagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtgcatgc

SEQ ID NO: 168061 - DNA, 2539 bp, Homo sapiens
  Payload ID: 13054
  Gene Symbol: KCNJ1
  Gene Name: potassium channel, inwardly rectifying subfamily J, member 1
  Uniprot ID: P48048
  ENST ID: ENST00000440599
  CDS Start-End: 353-1471
gcatacagatgagttggcagccggtctgagctggcccacagactcataaaatcaacagggcctcgggtaccctcacctagcatatccaaactcttgcatcaaaggtgcagggacttgctcacatcgagaatctggttgctttcttggagaccaagaaaatgagtttttgtttctacatttactccagcaatccatgaggactttataggaattttgcaccattctgaatggatacatttggatttctcaacatttgttcagcttcctaatgactgttgtgacaattgctctataccagtgaatgccaactgtttatctctgctctgaacagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttc

SEQ ID NO: 168062 - DNA, 5293 bp, Homo sapiens
  Payload ID: 13055
  Gene Symbol: KCNJ10
  Gene Name: potassium channel, inwardly rectifying subfamily J, member 10
  Uniprot ID: P78508
  ENST ID: ENST00000368089
  CDS Start-End: 228-1367
ggcgctgcggagggagggggcggcccggcccggcccagctctgcccccggccggcccgaccccggccccggcccccggacaagcccttatctgatcccagctccgggtttaagagtcctggcccggcccgtcgcacagctctgctcctaactcctgcccgccccgtccgtccatctgtcccgctgccccgcggcccatccaaggggccactccacctcggacccaagatgacgtcagttgccaaggtgtattacagtcagaccactcagacagaaagccggcccctaatgggcccagggatacgacggcggagagtcctgacaaaagatggtcgcagcaacgtgagaatggagcacattgccgacaagcgcttcctctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggtaccttcctggcgaagattgcccggcccaagaagcgggctgagaccattcgtttcagccagcatgcagttgtggcctcccacaatggcaagccctgcctcatgatccgagttgccaatatgcgcaaaagcctcctcattggctgccaggtgacaggaaaactgcttcagacccaccaaaccaaggaaggggagaacatccggctcaaccaggtcaatgtgactttccaagtagacacagcctctgacagccccttccttattctaccccttaccttctatcatgtggtagatgagaccagtcccttgaaagatctccctcttcgcagtggtgagggtgactttgagctggtgctgatcctaagtgggacagtggagtccaccagtgccacctgtcaggtgcgcacttcctacctgccagaggagatcctttggggctacgagttcacacctgccatctcactgtcagccagtggtaaatacatagctgactttagcctttttgaccaagttgtgaaagtggcctctcctagtggcctccgtgacagcactgtacgctacggagaccctgaaaagctcaagttggaggagtcattaagggagcaagctgagaaggagggcagtgcccttagtgtgcgcatcagcaatgtctgatgacctgttcccactcccccattcctctggtctcttttcctctcttccaatgccctggtaaggaatactacccgggtttactggagatcccccgaagcacccatcctccactccctcttctttaacccagtggcctgttggtagcttaggccaactggagtccaggttcgcctcccactgtcccctttccacttccccagcttctgccccaatacacatacctcccttaagccaggatgggggaaagagtgggattaggctgaagtggcttagaaggcctcagccatgcttggatactcacattaggaggaccatgtggttggaaggatagactgccccctacctcccaccaccaccatgaagtttggtgacttgaggctggagctccctctgttacctttccatctagcaagttcccaaaggcaagactctctctgatggtcactttgtggtctgtgctttcagaaatacaggaatctgatatcaacatatcctagggtttctaccaatctctgttgaaagaagccagggtttgccactgtgaagcttgatttctgctggtgacttctgaccataagctagaaccatggtcgccactgttttccctctgtagtttctcaagtgaacactctcaggatacccagttccctcatagcctctgttctcagagaattggagttggcccaagaaacataaacatataaccacccatatctatcctggattctgaactcttcaatttggagtgactaacacaagttgttatctaaacctttaaacctatcttccaggcagcccagagaagatctgtttccctgtgtcctgtgaatggaaggacccaagccaatatgttcctttgaaaagagtccagtacccaggccccatggaaaggtctgaaaataatattccagattacactgtacctggcttctcttcttcctttcctgctcagcctagatccttcttccttaaccccaactctttgggagaagggagggaaaatgcaagggccttcctctcttaacacggatgctcaagtaaaactagattcacagggcacagattccccagaaagttaacacaatcccaccatgagggatgggtaaattctcagatttccaaactgctgtacagagcctctgagaattggtgatgctttgttaaggtttgggcaggagcagaactctgtggctggcagccactattctcagttacacctcccagtgcccttctgaaaagtgccagctatttcattaggcaatgctggaaggaaatgaaattataccttctgatcaaataaccatggcttccctcagccattcctgagacttggtataaaatgaagaaatcagtgtcatctctactctcctctgccatgaggccattttcagacaagttaaaaagtagactttaagagatcaaactcagcctattccttgttccctggtggggtctgtggtaagggtcagggaagggcatataggcaccagagctttatccaaagccccaaatccctagagtgctttctggtctcactttggtaccaaggaagcctcacatagtggtactgcatagtcccactataagtcaagttgcagtttaaggtggtctcagccaattgttacaagctacagaatatatacatgcatctatgtacagagccttgcagagaaacacaaaattttgaggctagacccatgatcaccaccaactataattgcacaaggtcttgttatattgatctctcctcgaactcaactaactatatcttgaaaacaaagacccttcggtgtccatctacagtaaaccccaccattaccttctagttggcataaaaacaagaaccacaaaaacttgaaaaatctgaaacagagaacagaaggccaagagccagcttctgcgttctcaactttattcaacattagacttaccttatttctttcagtgtgtagggacaagatgtactgctgtgtgtgtgtgtgtgtgtgtgtgtgtgtgtgtgtgtgtgtgtgtgtgtgtctataccttcctatccattgccaagttaacctccatctggtttatttggccatgctatgctttcttcccattcccctgctgtctattctaagcccccagactcaagcctctagactcttggatgaaacagtgagaagaaaacattttctgacttacccttttggaatctcctccattattacccaggctttgctttaagttgcactttaaatcacactgtcctattaatgcgatctggcatcttctcccacaagccccctacagggaacaactaccccctaccttaactctaaatggttctttagactatagtctgtctcctctgacctgaaatcctcttttaggcaataggccgagctttagaagcagccaggtctggtgagaaatgggcccccataccaactgtggacttggaatatcagcagagtagtaggcacagttgtaaaaaggggagatttcggtaggcacaggtgtaaaaaggggagatttcagaagacgggcgaaacaactgatgggggaagatacctggggtgagaagatgagaaagaaatgatgctgagggacctagtgaaatcaatgaaactcttgagtcttgcttaggctcgcaaacaagaagtggggaggcttgggaaattaggatatgacatatatgaaaggtttatctaagaagaaagaaacagagataatatatatatagaaagatgtatatagatgtatatatgcccaaatatattgaatgtacagaaaggaaatattcagagactttagcattgggggcagatatcttggcctggttatggggtaggacacccagattttcagacttacaatcagtggtcctggtttcaacatggaagtgagatagctgatgaaggatttcaagtctggaaatgggaaagggaggggtagaagttccttttcagaaataaagaggcattcatgaaggcttttgttgaatcctatgctactgataggaccaggaagagaggaactcggaggacaatagggaggggaagtcttggaaaatctaccacttacactgtgtgtccccatccccagcagcgtcctgccactgtagcgcctttttaaaataaataaaataaaataaagcaccattttgtttccctttcatgaagtacactgtatttccgtcttccacaggggtgggagctgctattgctctagcccctgaaatcaaactcaggagctgaacactttggtgtatgggaggcactaatgggaagcctcaaccctggaatccaaatgccaggactaatagctgttaggctgaagatctcccaaggtcaaggcccagccttttgtgtggctgcaagcagcccaaagagaaagccatggattccagaagagttccaatcctggcatttgggcatggagggtgatgctttggttttgatgcttctgaatgaaaatgaggagtggggttaccagctgctctaggggatggtgaagttccatgagaggcttccgaaatctctgcaatgtgcttcaccccattattcccccaacccctgtcagcctaataaaatcatccagtagtttccctataaggtctgagcagagaaagaaagccagttatactattgctacaagtccaggacactgtgccctctccatggctgctgccctggtcctttattcttgctagctaacctagttcacttgtacagtaacacactacctttgctggaaagttagcatgggtctccaggctcagtaatggccaactctactgatgcagaagtatttagggatgttttttccattcattgcactaaagactaaaccaggtcaaatttatctaggaaaaaaaaggtgtgtaagatttgttttgtttttgtctgttaaaaataagctactaaataaaatggatgactctttggttgtca

SEQ ID NO: 168063 - DNA, 2801 bp, Homo sapiens
  Payload ID: 13056
  Gene Symbol: KCNJ11
  Gene Name: potassium channel, inwardly rectifying subfamily J, member 11
  Uniprot ID: Q14654
  ENST ID: ENST00000339994
  CDS Start-End: 569-1741
ggcagggttgggggctccctaggcgccaggcaggtgggctcaagggtgaggctgttttttttgttttgttttttgtttttgagacggagtctcgctctgtcgcccaggctggagtgcagtggcgtgatcttggctcactgcaacctccgcctctcgggttcaagcgattctcctgcctcagcttcctgagtagctgggattacaggtgcgcaccaccatgcccggctaacttttgtatttttagtagagatggggtttcaccatgttggtcaggctggtctcgaactcctgacctagtgatctgccctcctcagcctcccaacgtactgggattacaggcgtgagccaccgcgcccggcctgaggctggtattaagaagtgaagtgggacccaggtggaggtaaggaagagtctggtggggagttatctcagaagtgaggccagcacaggctgagtgcagccccagggtgagaaggtgcccaccgagaggactctgcagtgaggccctaggccacgtccgaggggtgcctccgatgggggaagcccctccctgggggtcaccggagccatgctgtcccgcaagggcatcatccccgaggaatacgtgctgacacgcctggcagaggaccctgccaagcccaggtaccgtgcccgccagcggagggcccgctttgtgtccaagaaaggcaactgcaacgtggcccacaagaacatccgggagcagggccgcttcctgcaggacgtgttcaccacgctggtggacctcaagtggccacacacattgctcatcttcaccatgtccttcctgtgcagctggctgctcttcgccatggcctggtggctcatcgccttcgcccacggtgacctggcccccagcgagggcactgctgagccctgtgtcaccagcatccactccttctcgtctgccttccttttctccattgaggtccaagtgactattggctttggggggcgcatggtgactgaggagtgcccactggccatcctgatcctcatcgtgcagaacatcgtggggctcatgatcaacgccatcatgcttggctgcatcttcatgaagactgcccaagcccaccgcagggctgagaccctcatcttcagcaagcatgcggtgatcgccctgcgccacggccgcctctgcttcatgctacgtgtgggtgacctccgcaagagcatgatcatcagcgccaccatccacatgcaggtggtacgcaagaccaccagccccgagggcgaggtggtgcccctccaccaggtggacatccccatggagaacggcgtgggtggcaacagcatcttcctggtggccccgctgatcatctaccatgtcattgatgccaacagcccactctacgacctggcacccagcgacctgcaccaccaccaggacctcgagatcatcgtcatcctggaaggcgtggtggaaaccacgggcatcaccacccaggcccgcacctcctacctggccgatgagatcctgtggggccagcgctttgtgcccattgtagctgaggaggacggacgttactctgtggactactccaagtttggcaacaccgtcaaagtgcccacaccactctgcacggcccgccagcttgatgaggaccacagcctactggaagctctgaccctcgcctcagcccgcgggcccctgcgcaagcgcagcgtgcccatggccaaggccaagcccaagttcagcatctctccagattccctgtcctgagccatggtctctcgggccccccacacgcgtgtgtacacacggaccatgtggtatgtagcccggccagggcctggtgtgaggctgggccagcctcagctcagcctccccctgctgctcatccagggtgttacaaggcacttgtcactatgctatttctggcctcagcaggaacctgtactgggttatttttgtccctgctcctcccaacccaattcaggactggctcacccctctcccccgcccaaggctgcagaggctgtgggaggtactgggccctagagctgtgcgtccagccagtcctgggtccccacgattgaccagccacactctgggccggtggctggggaagaacaatccccgagggctgctgctttgcgtctgtggctccaagaagtgcctgtggtcaggccccagctctacttggtccctgaaaaagcacctggctaagggctgggcctggccagcagggagggcagttgatgagagagggtgttcccgctggagggttggtgctgtggagcctacaccggcagggacagcctggggctgacagggctcccctccgagggccagtttcaggtctggaaggggaggaagcaggggaaggtgacctgaggaggctcggctttgtagagccccgctcaggcacagggaggaggagatgccagggctcctgccttttgccacatcggcctcgtgcagtgagggctctgtgggctggggctgctgcccctgcctacctcctgcctgtccccagaggctgaggagagggggtactgtgcccaccacacatgattaggcctcagacccaactctggtcctggctccacaacagtggctgccactcactttgtccagaaggtggcttgggggtggatatctttgggttgctggaaaaggtgtgggaaggttcaggatggtgggagggactgaggtccctgaggtgaagaggcccttggtcctgacgggtttgacccgtgcctggacccttggagcagtgttgtgtgaacttgcctagaactctgccttctccgttgtcaataaagcctccccctcatga

SEQ ID NO: 168064 - DNA, 781 bp, Homo sapiens
  Payload ID: 13056
  Gene Symbol: KCNJ11
  Gene Name: potassium channel, inwardly rectifying subfamily J, member 11
  ENST ID: ENST00000526912
  CDS Start-End: 321-781
tcggagtcagccccgccgggtcgcgcgcaggtccggggagccgcggttgagccgggtggggtggtgactccagagaacgcaggatcccaaggagacagagaggacgagagctggagggggatccggaaagcggcgggggcgctccgggaggggtggagtaggacatagggggcgcacctggaggagagacggggcgggggtggccaggacctgagctggagcctgggagcccgaaggccagacagggcatcatccccgaggaatacgtgctgacacgcctggcagaggaccctgccaagcccagctggctgctcttcgccatggcctggtggctcatcgccttcgcccacggtgacctggcccccagcgagggcactgctgagccctgtgtcaccagcatccactccttctcgtctgccttccttttctccattgaggtccaagtgactattggctttggggggcgcatggtgactgaggagtgcccactggccatcctgatcctcatcgtgcagaacatcgtggggctcatgatcaacgccatcatgcttggctgcatcttcatgaagactgcccaagcccaccgcagggctgagaccctcatcttcagcaagcatgcggtgatcgccctgcgccacggccgcctctgcttcatgctacgtgtgggtgacctccgcaagagcatgatcatcagcgccaccatccacatgcaggtggtacgcaagaccaccagccccgagggcgaggtggtgcccctccaccaggtggacatccccatgga

SEQ ID NO: 168065 - DNA, 2146 bp, Homo sapiens
  Payload ID: 13056
  Gene Symbol: KCNJ11
  Gene Name: potassium channel, inwardly rectifying subfamily J, member 11
  Uniprot ID: Q14654
  ENST ID: ENST00000528731
  CDS Start-End: 175-1086
gtgcgcccccctcccgccgtcctagacccctgcctagcccaggtcggtctccgcggacccacggacggacagacagacgggaggacggccagccgcgagcgcccgggcggcgggagggggcggggaggcgacggccgtggcgtgaggagcaggagcagctggctgctcttcgccatggcctggtggctcatcgccttcgcccacggtgacctggcccccagcgagggcactgctgagccctgtgtcaccagcatccactccttctcgtctgccttccttttctccattgaggtccaagtgactattggctttggggggcgcatggtgactgaggagtgcccactggccatcctgatcctcatcgtgcagaacatcgtggggctcatgatcaacgccatcatgcttggctgcatcttcatgaagactgcccaagcccaccgcagggctgagaccctcatcttcagcaagcatgcggtgatcgccctgcgccacggccgcctctgcttcatgctacgtgtgggtgacctccgcaagagcatgatcatcagcgccaccatccacatgcaggtggtacgcaagaccaccagccccgagggcgaggtggtgcccctccaccaggtggacatccccatggagaacggcgtgggtggcaacagcatcttcctggtggccccgctgatcatctaccatgtcattgatgccaacagcccactctacgacctggcacccagcgacctgcaccaccaccaggacctcgagatcatcgtcatcctggaaggcgtggtggaaaccacgggcatcaccacccaggcccgcacctcctacctggccgatgagatcctgtggggccagcgctttgtgcccattgtagctgaggaggacggacgttactctgtggactactccaagtttggcaacaccgtcaaagtgcccacaccactctgcacggcccgccagcttgatgaggaccacagcctactggaagctctgaccctcgcctcagcccgcgggcccctgcgcaagcgcagcgtgcccatggccaaggccaagcccaagttcagcatctctccagattccctgtcctgagccatggtctctcgggccccccacacgcgtgtgtacacacggaccatgtggtatgtagcccggccagggcctggtgtgaggctgggccagcctcagctcagcctccccctgctgctcatccagggtgttacaaggcacttgtcactatgctatttctggcctcagcaggaacctgtactgggttatttttgtccctgctcctcccaacccaattcaggactggctcacccctctcccccgcccaaggctgcagaggctgtgggaggtactgggccctagagctgtgcgtccagccagtcctgggtccccacgattgaccagccacactctgggccggtggctggggaagaacaatccccgagggctgctgctttgcgtctgtggctccaagaagtgcctgtggtcaggccccagctctacttggtccctgaaaaagcacctggctaagggctgggcctggccagcagggagggcagttgatgagagagggtgttcccgctggagggttggtgctgtggagcctacaccggcagggacagcctggggctgacagggctcccctccgagggccagtttcaggtctggaaggggaggaagcaggggaaggtgacctgaggaggctcggctttgtagagccccgctcaggcacagggaggaggagatgccagggctcctgccttttgccacatcggcctcgtgcagtgagggctctgtgggctggggctgctgcccctgcctacctcctgcctgtccccagaggctgaggagagggggtactgtgcccaccacacatgattaggcctcagacccaactctggtcctggctccacaacagtggctgccactcactttgtccagaaggtggcttgggggtggatatctttgggttgctggaaaaggtgtgggaaggttcaggatggtgggagggactgaggtccctgaggtgaagaggcccttggtcctgacgggtttgacccgtgcctggacccttggagcagtgttgtgtgaacttgcctagaactctgccttctccgttgtcaataaagcctccccctcatga

SEQ ID NO: 168066 - DNA, 466 bp, Homo sapiens
  Payload ID: 13056
  Gene Symbol: KCNJ11
  Gene Name: potassium channel, inwardly rectifying subfamily J, member 11
  ENST ID: ENST00000528992
  CDS Start-End: 1-466
agctggagcctgggagcccgaaggccagacagggcatcatccccgaggaatacgtgctgacacgcctggcagaggaccctgccaagcccaggtaccgtgcccgccagcggagggcccgctttgtgtccaagaaaggcaactgcaacgtggcccacaagaacatccgggagcagggccgcttcctgcaggacgtgttcaccacgctggtggacctcaagtggccacacacattgctcatcttcaccatgtccttcctgtgcagctggctgctcttcgccatggcctggtggctcatcgccttcgcccacggtgacctggcccccagcgagggcactgctgagccctgtgtcaccagcatccactccttctcgtctgccttccttttctccattgaggtccaagtgactattggctttggggggcgcatggtgactgaggagtgcccactggccatcctgatcctcat

SEQ ID NO: 168067 - DNA, 2198 bp, Homo sapiens
  Payload ID: 13057
  Gene Symbol: KCNJ12
  Gene Name: potassium channel, inwardly rectifying subfamily J, member 12
  Uniprot ID: Q14500
  ENST ID: ENST00000331718
  CDS Start-End: 371-1672
agcaggccacagggaggcttgggcacagccagctttccgtcctgttgggaagcctgtttctgctttcagtgcccacgtggtgtcaggaacgccggtcacagtgaacgcctgcaggacccacactgctgcatcgtctctgtgggacagatactgaagccagggcttggcttacccttgtgacagtctcccgaggatgttctagtgactggatcctttccagttggtgcctgggaaatggcagccactactaattcagccttgaagacagtaccgtgcccactcagcaccattacatagaagatagaactcaagaggagccgccctgcctggagctagcctgggggcgagccagggtcccccaacccccgggatgaccgcggccagccgggccaacccctacagcatcgtgtcatcggaggaggacgggctgcacctggtcaccatgtcgggcgccaacggcttcggcaacggcaaggtgcacacgcggcgcaggtgccgcaaccgcttcgtcaagaagaatggccagtgcaacattgagttcgccaacatggacgagaagtcacagcgctacctggctgacatgttcaccacctgtgtggacatccgctggcggtacatgctgctcatcttctcgctggccttccttgcctcctggctgctgttcggcatcatcttctgggtcatcgcggtggcacacggtgacctggagccggctgagggccggggccgcacaccctgtgtgatgcaggtgcacggcttcatggcggccttcctcttctccatcgagacgcagaccaccatcggctacgggctgcgctgtgtgacggaggagtgcccggtggccgtcttcatggtggtggcccagtccatcgtgggctgcatcatcgactccttcatgattggtgccatcatggccaagatggcaaggcccaagaagcgggcacagacgctgctgttcagccacaacgccgtggtggccctgcgtgacggcaagctctgcctcatgtggcgtgtgggtaacctgcgcaagagccacattgtggaggcccatgtgcgcgcgcagctcatcaagccgcgggtcaccgaggagggcgagtacatcccgctggaccagatcgacatcgatgtgggcttcgacaagggcctggaccgcatctttctggtgtcgcccatcaccatcttgcatgagattgacgaggccagcccgctcttcggcatcagccggcaggacctggagacggacgactttgagatcgtggtcatcctggaaggcatggtggaggccacagccatgaccacccaggcccgcagctcctacctggccaatgagatcctgtggggtcaccgctttgagcccgtgctcttcgaggagaagaaccagtacaagattgactactcgcacttccacaagacctatgaggtgccctctacgccccgctgcagtgcgaaggatctggtagagaacaagttcctgctgcccagcgccaactccttctgctacgagaacgagctggccttcctgagccgtgacgaggaggatgaggcggacggagaccaggacggccgaagccgggacggcctcagcccccaggccaggcatgactttgacagactccaggctggcggcggggtcctggagcagcggccctacagacgggagtcagagatctgagccaaccttggccgacatgcagcatccacccccggctggggagaggccccgcggtcgctcaggggccccgggtttgagcagaacgggcccagtgccctgggttgcagactcagtagcgttttagtcgttttatgtttctttgcaacggcctcagaagtttggccggagagggggcagccagagcggcagcccccggcctcagaggctatcacaggctcagggcaaagaagtggcctcctggggggccaggccacgagggccagggcttctgcctgaagatggagctgcagcctgcggggaagcagctcagctcgatggtgggcccagcctctgctgtccaaggctggctagctgcggtgctccttgctggtttttaacttggggagaaacaccgggtttcagctttcttgaccttagcttgggtgagactgtttacaaaaaaaaaaaattaccatgcaattgaaaaaatttttttttaattcacagggggcaaaaagaacaattagaattccatgggtctgccagg

SEQ ID NO: 168068 - DNA, 5425 bp, Homo sapiens
  Payload ID: 13057
  Gene Symbol: KCNJ12
  Gene Name: potassium channel, inwardly rectifying subfamily J, member 12
  Uniprot ID: Q14500
  ENST ID: ENST00000583088
  CDS Start-End: 896-2197
cgcgcgcgtcccagtgcgcaagtggctggcggtgtgtgtgtagggggcggcccgggactaggaggggctcggggccaggccggagccgtggtaggctggtgcagcggctgcgcggcgcggcgcggcgcggggcgggcgtgctctccgcggagagttagaggagttgccgagctgagctccggtggagcgaggcgcggagctgggtgcgcgccgagcctctgcctcccgccgcctcctcgccctccattcctcgctccccgtcttctcccggccacaccgccactgctgccgcctccctgggaacagtagccgggggagggggactggcgcggtcagagcctgcgaggaggtgcggggcgccggggcgtaggggagcgcgccgggccctgcccgagatcagataacagccggcgggggagggggtgggccggccgtgctcacagccggaccgagggaccgacgccagccgccccggcccaagcgagcgcccagcggccgggggcgccgtccaggcgcgcgcccccgacccgtggctggaccagggcgatccgctttgcagagaagacgcgcccctcggcatggagcgcccccgggagctgccctgaggcggtggcggcagcggcggcgatgcagccagcgcggcagctgccggggccaggaacggccgcccggagcttggaggacgccgagcgcgccgcgcccgggccactgaccgaggatgttctagtgactggatcctttccagttggtgcctgggaaatggcagccactactaattcagccttgaagacagtaccgtgcccactcagcaccattacatagaagatagaactcaagaggagccgccctgcctggagctagcctgggggcgagccagggtcccccaacccccgggatgaccgcggccagccgggccaacccctacagcatcgtgtcatcggaggaggacgggctgcacctggtcaccatgtcgggcgccaacggcttcggcaacggcaaggtgcacacgcggcgcaggtgccgcaaccgcttcgtcaagaagaatggccagtgcaacattgagttcgccaacatggacgagaagtcacagcgctacctggctgacatgttcaccacctgtgtggacatccgctggcggtacatgctgctcatcttctcgctggccttccttgcctcctggctgctgttcggcatcatcttctgggtcatcgcggtggcacacggtgacctggagccggctgagggccggggccgcacaccctgtgtgatgcaggtgcacggcttcatggcggccttcctcttctccatcgagacgcagaccaccatcggctacgggctgcgctgtgtgacggaggagtgcccggtggccgtcttcatggtggtggcccagtccatcgtgggctgcatcatcgactccttcatgattggtgccatcatggccaagatggcaaggcccaagaagcgggcacagacgctgctgttcagccacaacgccgtggtggccctgcgtgacggcaagctctgcctcatgtggcgtgtgggtaacctgcgcaagagccacattgtggaggcccatgtgcgcgcgcagctcatcaagccgcgggtcaccgaggagggcgagtacatcccgctggaccagatcgacatcgatgtgggcttcgacaagggcctggaccgcatctttctggtgtcgcccatcaccatcttgcatgagattgacgaggccagcccgctcttcggcatcagccggcaggacctggagacggacgactttgagatcgtggtcatcctggaaggcatggtggaggccacagccatgaccacccaggcccgcagctcctacctggccaatgagatcctgtggggtcaccgctttgagcccgtgctcttcgaggagaagaaccagtacaagattgactactcgcacttccacaagacctatgaggtgccctctacgccccgctgcagtgcgaaggatctggtagagaacaagttcctgctgcccagcgccaactccttctgctacgagaacgagctggccttcctgagccgtgacgaggaggatgaggcggacggagaccaggacggccgaagccgggacggcctcagcccccaggccaggcatgactttgacagactccaggctggcggcggggtcctggagcagcggccctacagacgggagtcagagatctgagccaaccttggccgacatgcagcatccacccccggctggggagaggccccgcggtcgctcaggggccccgggtttgagcagaacgggcccagtgccctgggttgcagactcagtagcgttttagtcgttttatgtttctttgcaacggcctcagaagtttggccggagagggggcagccagagcggcagcccccggcctcagaggctatcacaggctcagggcaaagaagtggcctcctggggggccaggccacgagggccagggcttctgcctgaagatggagctgcagcctgcggggaagcagctcagctcgatggtgggcccagcctctgctgtccaaggctggctagctgcggtgctccttgctggtttttaacttggggagaaacaccgggtttcagctttcttgaccttagcttgggtgagactgtttacaaaaaaaaaaaattaccatgcaattgaaaaaatttttttttaattcacagggggcaaaaagaacaattagaattccatgggtctgccaggatgcagcagctggctgaaggctccagagggttccccgaggtgggactggcctctccccgtgtgtgtgggcaccacagtccctgggcaagcagggtgctctgggaccgcacttcatcgagctcacgagccagctaggctctgtttgtgatagaaaaatcaagaccatgttaatgatcgtaataaaagctttctactgtcgttggggtggtgggtggggctgggaagaaactggtttgagcttttagagtttgcctttgtaccttagagatgtgtctcagggccaggcatgggacctgccatcgagggttcctccccgcaccctcgattttcctgttttgcttctctctccatttctgtccaggcctccgcccaattccacagtgaggggtggttaggagctataggccgggatggctccttgggaagggaagtcgggatcccaggctaggaggaagctggcagccccgtccccactgggcccacagtgtgagtcgtgccttagagactccgggttgtcctgttctttctgggcttgctcatctccccccaaccctgtcccaccccacccctcccatacctccactgctgaagttcctccagcccctctgtctgccttgtgaaggtggcaggggccaggtctgcctgacataggaccacatcctgtccctccctcacctggagcagcacagcagagttcaggcagggcacagccaggccctggtcagcgctgaatggcagaggaaagatcttaggaaaggagaggaatcgccaccccctcctgccaactgggatgactggggagggccacgctcattcaaagctgaatcagaaaccagccgtggaacagaattcctgccgagtcttccagggccgctcctccaccaccctcccccaggttgaggcactatggcaccctcatcaggaagaggtttggggtccccttgttgtcactgctggctctgccaccccatcttgttcatggcagctggttgggtcaggtccatggtagagccaggcccttcccagggctgcggagaaaacctgctctcttctagtcgggcttctccagaagccagtaatcagaaaggatgtgtctcctgctccaactctgcccccgagacagctcagagccagaaggcaccccgagacagctcagagccagaaggcaccccgagacagctcagagccagaaggcaccgaggactctggcccaagtggggaagctgaggcagagagcagagggggtcatgcagtgagtgggtggggtgcaggagacagagaggggctgggggcgtggggtgggggtgtctgcctcttccctccacctcctcccctccttagcagctgaagactcagccctgaggtctggggcaatggaagtcaagacacccgacccctacatcctggggtaggcccgactcagcatcctgtcccagcttcagccccacactcatttctggcatagaagattccgccgaggcagctctttcctctcggggtctgccaggggtgcctcagctggttcctgctcccaggcctagccccgaagccttaggggccttctcagccttagccctgggtactggggtgaagttggcaggggagagcttgacacttcgcctccctgatggccatgctgagggacagtggtgaccctggtcacttggtgctggtgtaggggcctgtgcccttccagggccagtgagacagccttctactcccccgacccagagctgagtccgaggaccccaggcccacctcctggccctcttggaggtctgtgctcttacctcccagcccccaccctgcgggagagcagccccagcgcctcatctccccaaaggcggcagatgcttgattctcctgccctctttcttccttccctcgtatttatttatttatttattgcttgtgctaaagaccaaaatagtctccctctttagtgcacttgaagcgggagggcggatgggatgagccaggagcgaggaagacttggcccctggggagtgtgtgtgtggaggcgtgtgcctgtgtgagcctgcatgcatacatgtgtggtgcacacatgcacactcggctcttcatgtgtatgactgggttagtaatacagatacgtgatctatacgtgtgtgtgtgtgtgtgtgtgtgtgtgtgtgtgtatgcaggcggttatgtgtctgtctacccccaggtgtttccgtgtacaagtttcctgtgagggagggcacccacccatcaggttgggcactggcacaggtgaaccccacagtccccgaccctctgccctgattatgcacgtctgctcctgagtggagcttgtgttccaggatgagacatctggaggtgagcgtgtgcgtccggctcgtgtgtaggaggctgtgtgtgtgcccatgtgaaaccgtgtacttgagtgtgtgtctgtgtgcagcctatgcctgctgctcagagcacggtggccaccccctgagcctctgctggtgctgtgctgcgtggtccccacccagagggtcctggggggcggggaggagccaccgttgggaggcccctgtacggggtgtctgccctgcgtgagggcatagaatgtcaaattattttaaatggtgaaactggagagttttcatgttattttcaatacatagcagtatctaaagacgtaggcgatgagactagaccacattaaatgcattttgatctctttgagg

SEQ ID NO: 168069 - DNA, 2950 bp, Homo sapiens
  Payload ID: 13058
  Gene Symbol: KCNJ13
  Gene Name: potassium channel, inwardly rectifying subfamily J, member 13
  Uniprot ID: O60928
  ENST ID: ENST00000233826
  CDS Start-End: 141-1223
accagtccaagaagagaacctacaaactagacttgtagattaaaattatctgatcaaaaaggcagactctgtaaatttccttaagacctaccttggcataaaggctgacccagcaaaagaactgagaaatacagcctgagatggacagcagtaattgcaaagttattgctcctctcctaagtcaaagataccggaggatggtcaccaaggatggccacagcacacttcaaatggatggcgctcaaagaggtcttgcatatcttcgagatgcttggggaatcctaatggacatgcgctggcgttggatgatgttggtcttttctgcttcttttgttgtccactggcttgtctttgcagtgctctggtatgttctggctgagatgaatggtgatctggaactagatcatgatgccccacctgaaaaccacactatctgtgtcaagtatatcaccagtttcacagctgcattctccttctccctggagacacaactcacaattggttatggtaccatgttccccagtggtgactgtccaagtgcaatcgccttacttgccatacaaatgctcctaggcctcatgctagaggcttttatcacaggtgcttttgtggcgaagattgcccggccaaaaaatcgagctttttcaattcgctttactgacacagcagtagtagctcacatggatggcaaacctaatcttatcttccaagtggccaacacccgacctagccctctaaccagtgtccgggtctcagctgtactctatcaggaaagagaaaatggcaaactctaccagaccagtgtggatttccaccttgatggcatcagttctgacgaatgtccattcttcatctttccactaacgtactatcactccattacaccatcaagtcctctggctactctgctccagcatgaaaatccttctcactttgaattagttgtattcctttcagcaatgcaggagggcactggagaaatatgccaaaggaggacatcctacctaccgtctgaaatcatgttacatcactgttttgcatctctgttgacccgaggttccaaaggtgaatatcaaatcaagatggagaattttgacaagactgtccctgaatttccaactcctctggtttctaaaagcccaaacaggactgacctggatatccacatcaatggacaaagcattgacaattttcagatctctgaaacaggactgacagaataagacttatccattttttaatgtattaaatacacccagccagttatgcagctactttttctttactgtatctcatgttttcttttttcaatgctaattatagctctctacatcacggtaatcatgcctatgcctacataagaatggctgagctaacaatacacattctggaaacataacactctacattacaaagtttgttacctgctgaaatcaatgtaactcaacttgacagacacttatacagaaatgttgctggtgaatttataagaatgtggtatgatactagtaatgaaggcaaaatggacagtgaagtttaacacaactgaactctaagaaaatcaaccattaatctctcattttcatctgcaaattgaagcaacagtttagtttcaaacctagctccctgggtggaatgacgacttcactatacttagtgaatatcctttaagagctgggatttttttcaagacaacaaagatcattcatttggttctttatactatgaaacttgagtaagtattacctccttaatttttaacaactaagaacaaaaattaacgagaaaaacaacaaagtacagatttatacataaacctaaaagcatttgaacatgacacccgaacacatacatatatgttcacttatttgtggcagaaggtgatcagataagctccagcccaaatggaacctgtggggtggtattttgcattgcaaggagacgcaaaattttattttaaaactgtcctccataataatcaaacggtgattcatctaaatgacttctagcaacctaagtaaaaacattcccctcctatgtatgattcatttgatcatataaaacatcatgatggctctaattcataaatacaaaaatatatttaagtctttatagatataaagctttacttagatataacttgagtgagtagggaaaaaaatctacagtagataaagcaaaagataattaggcaacaaagcattttcaaactcaaattcctgtttccaacttcaaatagttttttctataaacacaaaatcagtgtttattcaccagtaggaggttggactagatgaactctattatttctttctaaatctaatagtctataaaaattatgtttcctctgttttttattttatctatgctaaaatgagccctttcccttatgtccagtttaagatgatcatttgcatgattttcatttcaataaaaaaaagagaaactgtccttaaaacaaaacaaaaaccaaaaaagtcaccctatcaggtttcaaacagatttgtggctgttcttttctgaaatttcccttattcaggtttctgtgggaaaaatgaaagattaaccttccccactggtgatgacctaggcaggaatcatctcttgaaataaatactagctgagtaaaggcaagcaggtgtgaagagcagggctcagcagcaagtcacatttttctactatttgaccaaaaggaaaagaaaataaagaagaactctggagtggtctaagactgataatagcagaagaatatcaagaacacagaaacttaattattgtgaacttttgctgtttgaaaatcttagacattcattcttaagtagaaatcagaccaacagattttcccaacccaagactattgtaacacataaagacagcaagaattcttatttctataataaattaacaagattcacctaacctttgaaaataaagtagtattgaagactta

SEQ ID NO: 168070 - DNA, 1177 bp, Homo sapiens
  Payload ID: 13058
  Gene Symbol: KCNJ13
  Gene Name: potassium channel, inwardly rectifying subfamily J, member 13
  Uniprot ID: O60928
  ENST ID: ENST00000410029
  CDS Start-End: 44-1126
agcttactaatttactcttgattttagagaaatacagcctgagatggacagcagtaattgcaaagttattgctcctctcctaagtcaaagataccggaggatggtcaccaaggatggccacagcacacttcaaatggatggcgctcaaagaggtcttgcatatcttcgagatgcttggggaatcctaatggacatgcgctggcgttggatgatgttggtcttttctgcttcttttgttgtccactggcttgtctttgcagtgctctggtatgttctggctgagatgaatggtgatctggaactagatcatgatgccccacctgaaaaccacactatctgtgtcaagtatatcaccagtttcacagctgcattctccttctccctggagacacaactcacaattggttatggtaccatgttccccagtggtgactgtccaagtgcaatcgccttacttgccatacaaatgctcctaggcctcatgctagaggcttttatcacaggtgcttttgtggcgaagattgcccggccaaaaaatcgagctttttcaattcgctttactgacacagcagtagtagctcacatggatggcaaacctaatcttatcttccaagtggccaacacccgacctagccctctaaccagtgtccgggtctcagctgtactctatcaggaaagagaaaatggcaaactctaccagaccagtgtggatttccaccttgatggcatcagttctgacgaatgtccattcttcatctttccactaacgtactatcactccattacaccatcaagtcctctggctactctgctccagcatgaaaatccttctcactttgaattagttgtattcctttcagcaatgcaggagggcactggagaaatatgccaaaggaggacatcctacctaccgtctgaaatcatgttacatcactgttttgcatctctgttgacccgaggttccaaaggtgaatatcaaatcaagatggagaattttgacaagactgtccctgaatttccaactcctctggtttctaaaagcccaaacaggactgacctggatatccacatcaatggacaaagcattgacaattttcagatctctgaaacaggactgacagaataagacttatccattttttaatgtattaaatacacccagccagttatgcagcta

SEQ ID NO: 168071 - DNA, 1099 bp, Homo sapiens
  Payload ID: 13058
  Gene Symbol: KCNJ13
  Gene Name: potassium channel, inwardly rectifying subfamily J, member 13
  Uniprot ID: O60928
  ENST ID: ENST00000409779
  CDS Start-End: 138-422
agtccaagaagagaacctacaaactagacttgtagattaaaattatctgatcaaaaaggcagactctgtaaatttccttaagacctaccttggcataaaggctgacccagcaaaagaactgagaaatacagcctgagatggacagcagtaattgcaaagttattgctcctctcctaagtcaaagataccggaggatggtcaccaaggatggccacagcacacttcaaatggatggcgctcaaagaggtcttgcatatcttcgagatgcttggggaatcctaatggacatgcgctggcgttggatgatgttggtcttttctgcttcttttgttgtccactggcttgtctttgcagtgctctggtgcttttgtggcgaagattgcccggccaaaaaatcgagctttttcaattcgctttactgacacagcagtagtagctcacatggatggcaaacctaatcttatcttccaagtggccaacacccgacctagccctctaaccagtgtccgggtctcagctgtactctatcaggaaagagaaaatggcaaactctaccagaccagtgtggatttccaccttgatggcatcagttctgacgaatgtccattcttcatctttccactaacgtactatcactccattacaccatcaagtcctctggctactctgctccagcatgaaaatccttctcactttgaattagttgtattcctttcagcaatgcaggagggcactggagaaatatgccaaaggaggacatcctacctaccgtctgaaatcatgttacatcactgttttgcatctctgttgacccgaggttccaaaggtgaatatcaaatcaagatggagaattttgacaagactgtccctgaatttccaactcctctggtttctaaaagcccaaacaggactgacctggatatccacatcaatggacaaagcattgacaattttcagatctctgaaacaggactgacagaataagacttatccattttttaatgtattaaatacacccagccagttatgcagctactttttctttactgtatctcatgttttcttttttcaatgctaattatagctctctacatcacgg

SEQ ID NO: 168072 - DNA, 687 bp, Homo sapiens
  Payload ID: 13058
  Gene Symbol: KCNJ13
  Gene Name: potassium channel, inwardly rectifying subfamily J, member 13
  ENST ID: ENST00000438786
  CDS Start-End: 135-687
gagaacctacaaactagacttgtagattaaaattatctgatcaaaaaggcagactctgtaaatttccttaagacctaccttggcataaaggctgacccagcaaaagaactgtgctctggtatgttctggctgagatgaatggtgatctggaactagatcatgatgccccacctgaaaaccacactatctgtgtcaagtatatcaccagtttcacagctgcattctccttctccctggagacacaactcacaattggttatggtaccatgttccccagtggtgactgtccaagtgcaatcgccttacttgccatacaaatgctcctaggcctcatgctagaggcttttatcacaggtgcttttgtggcgaagattgcccggccaaaaaatcgagctttttcaattcgctttactgacacagcagtagtagctcacatggatggcaaacctaatcttatcttccaagtggccaacacccgacctagccctctaaccagtgtccgggtctcagctgtactctatcaggaaagagaaaatggcaaactctaccagaccagtgtggatttccaccttgatggcatcagttctgacgaatgtccattcttcatctttccactaacgtactatcactccattacaccatcaagtcctctggctactctgctccagcatgaaaatccttctcact

SEQ ID NO: 168073 - DNA, 495 bp, Homo sapiens
  Payload ID: 13058
  Gene Symbol: KCNJ13
  Gene Name: potassium channel, inwardly rectifying subfamily J, member 13
  ENST ID: ENST00000444142
  CDS Start-End: 1-412
cgctcaaagaggtcttgcatatcttcgagatgcttggggaatcctaatggacatgcgctggcgttggatgatgttggtcttttctgcttcttttgttgtccactggcttgtctttgcagtgctctggtatgttctggctgagatgaatggtgatctggaactagatcatgatgccccacctgaaaaccacactatctgtgtcaagtatatcaccagtttcacagctgcattctccttctccctggagacacaactcacaattggttatggtaccatgttccccagtggtgactgtccaagtgcaatcgccttacttgccatacaaatgctcctaggcctcatgctagaggcttttatcacaggagggcactggagaaatatgccaaaggaggacatcctacctaccgtctgaaatcatgttacatcactgttttgcatctctgttgacccgaggttccaaaggtgaatatcaaatcaagatggagaattttgaca

SEQ ID NO: 168074 - DNA, 2960 bp, Homo sapiens
  Payload ID: 13059
  Gene Symbol: KCNJ14
  Gene Name: potassium channel, inwardly rectifying subfamily J, member 14
  Uniprot ID: Q9UNX9
  ENST ID: ENST00000342291
  CDS Start-End: 406-1716
gtcaggtggaggatccctttccctcccgccctgcttttgctaggggaggggggtgccctgagcctgagtcgcagccagcctgggagctgggccatgttggccgcagatggccccctggtgaaggttcccgttggctttgggaagtagacaacgggtctgcctcacggggctgaggtgggactggaggatttcgagggcagaactctgggaaggaaagaaaggcttaggacccaaccagcattccccctggcactgcgggggcctggccagctcatggcgttccctgagcctgttccccaactgtgaaagggggtgatgatcttcacctcccggcatcctgagcggccaagcaggttgggggcgcctgccccccactaggccaagtggagggggtccctccgtccaatgggcctggccagggccctacgccgcctcagcggcgccctggattcgggagacagccgggcgggcgatgaagaggaggccgggcccgggttgtgccgcaacgggtgggcgccggcaccggtgcagtcacccgtgggccggcgccgcggtcgcttcgtcaagaaagacgggcactgcaacgtgcgtttcgtaaacctgggtggccagggcgcgcgctacctgagcgacctgttcaccacatgcgtggacgtgcgctggcgctggatgtgcctgctcttctcctgctccttcctcgcctcctggctgctcttcggcctggccttctggctcattgcctcgctgcacggcgacctggccgccccgccaccgcccgcgccctgcttctcacacgtggccagcttcctggccgccttcctcttcgcgctggagacgcagacgtccatcggctacggcgtgcgcagcgtcaccgaggagtgcccggccgctgtggccgccgtggtgctgcagtgcattgccggctgcgtgctcgacgccttcgtcgtgggtgctgtcatggccaagatggccaaacccaagaagcgcaacgagacgctggtcttcagcgagaacgccgtcgtggcgctgcgcgaccaccgcctctgcctcatgtggcgcgtcggcaacctgcgccgcagccacctggtcgaggcccacgtgcgtgcccagctgctgcagccccgtgtgaccccagagggtgagtacatcccgctggaccaccaggatgtggatgtgggctttgatggaggcaccgatcgtatcttcctcgtgtcccccatcaccatcgtccatgagatcgactctgccagtcctctgtatgagctaggacgtgccgagctggccagggctgactttgagctggtggtcattctcgaggggatggttgaggccacagccatgaccacacagtgtcgctcgtcctacctccctggtgaactgctctggggccatcgttttgagccagttctcttccagcgtggctcccagtatgaggtcgactatcgccacttccatcgcacttatgaggtcccagggacaccggtctgcagtgctaaggagctggatgaacgggcagagcaggcttcccacagcctcaagtctagtttccccggctctctgactgcattttgttatgagaatgaacttgctctgagctgctgccaggaggaagatgaggacgatgagactgaggaagggaatggggtggaaacagaagatggggctgctagcccccgagttctcacaccaaccctggcgctgaccctgcctccatgatgcaaactgatgtccccttccccgtgtatgcccccttccccaaggtagcaagatggagggatggggctctctcctgggatgggggcaggtgttcctgaataccgacaggcctgctgggtaaatgactaggtggtaaggttctgccatgcctggtgacccaccatggacatactggaccttaattcctctgcttctgtgctccctcctgagaaccctttatgagcctgattcctcagtctcaccagaattctggatcacccaagaggaaaagactggcagttctagattcctctatatggggagacctggattgttgaccagggtgagaagccaatggtatagactgcctctggggaagcaagttggcagttcttgaacagcatcagatatcaagagtttgtaggtctggattcacctaagattcaagggagtgttgcttctcaactcagccaactgagtagcaaatcatttgttctagaccacctaaggagggaaggttatggaatgccccaagtattcaagatcatcttgattgaccaaagaccaaaaaaaaaaaaaagacctgtggttccagaaagctcattagttgagattctgtgagtctaggttgaccacagaggcaagcactggtgagtctaggacagattttacgtggagagttgaactactccagaaactaaagagtaatgtttctagaatgcacaaaacattgttagtctgtgggtttagaaagactgaagtgacagattaagagttcttgatattagataactccaacttctggctgtagagcacccagccaagagaataagcagtgctttgaaaggatccactgggtgggttgtttttttttaaagtgccattctagaatgtccaaagggaatcaggattctgtggctgtagactgatcacagagtcaaggaagcagtggcaattctagatatctgagattttgctggttccagtttgcccaatggagttgagaatctcaatgattctagatgacttcttgtggttctgtaatgccaaaaggaatgaaggctccagggatacagagttgtccattaccaaagcctggaagttctcatcacctccaggtggactgcttggcagtgctaggaggtggactcaggacttcagaagcaacatttctggcctgacctggaaggtgaaggtgaaggtgagaccctgtagggcacagggctaattagtggacaagggaagggggaggcccagggctggtg
